US012612622B2

(12) United States Patent
Mei et al.

(10) Patent No.: US 12,612,622 B2
(45) Date of Patent: Apr. 28, 2026

(54) TARGETED MUTAGENESIS USING BASE EDITORS

(71) Applicant: Qi Biodesign Biotechnology Company Limited, Beijing (CN)

(72) Inventors: Yu Mei, Olivette, MO (US); Aaron Hummel, St. Louis, MO (US); Zarir Vaghchhipawala, Ballwin, MO (US); Caixia Gao, Beijing (CN); Chao Li, Beijing (CN); Rui Zhang, Beijing (CN)

(73) Assignee: Qi Biodesign Biotechnology Company Limited, Beijing (CN)

( * ) Notice: Subject to any disclaimer, the term of this patent is extended or adjusted under 35 U.S.C. 154(b) by 1307 days.

(21) Appl. No.: 17/290,807

(22) PCT Filed: Nov. 4, 2019

(86) PCT No.: PCT/EP2019/080140
§ 371 (c)(1),
(2) Date: May 3, 2021

(87) PCT Pub. No.: WO2020/089489
PCT Pub. Date: May 7, 2020

(65) Prior Publication Data
US 2021/0403901 A1 Dec. 30, 2021

Related U.S. Application Data

(60) Provisional application No. 62/754,281, filed on Nov. 1, 2018.

(51) Int. Cl.
*C12N 15/10* (2006.01)
*C12N 15/11* (2006.01)

(52) U.S. Cl.
CPC .......... *C12N 15/1058* (2013.01); *C12N 15/11* (2013.01); *C12N 2310/20* (2017.05); *C12N 2320/13* (2013.01); *C12N 2330/31* (2013.01)

(58) Field of Classification Search
CPC .... A01H 6/4636; C12N 15/10; C12N 15/102; C12N 15/1058; C12N 15/11; C12N 15/8213; C12N 15/8241; C12N 2310/20; C12N 2320/13; C12N 2330/31
See application file for complete search history.

(56) References Cited

FOREIGN PATENT DOCUMENTS

| WO | WO 2015/089406 A1 | 6/2015 |
| WO | WO 2017/070632 A2 | 4/2017 |
| WO | WO 2017/070633 A2 | 4/2017 |
| WO | WO 2018/027078 A1 | 2/2018 |
| WO | WO 2018/149915 A1 | 8/2018 |

OTHER PUBLICATIONS

Hess et al. (2016) "Directed Evolution Using dCas9-Targeted Somatic Hypermutation in Mammalian Cells," Nature Methods, vol. 13, No. 12, pp. 1036-1042.
International Preliminary Report on Patentability (Chapter I of the Patent Cooperation Treaty) corresponding to International Patent Application No. PCT/EP2019/080140 dated Apr. 27, 2021.
International Search Report corresponding to International Patent Application No. PCT/EP2019/080140 dated Jan. 17, 2020.
Jiang et al. (2018) "BE-PLUS: a New Base Editing Tool with Broadened Editing Window and Enhanced Fidelity," Cell Research, vol. 28, pp. 855-861.
Kim (2018) Precision Genome Engineering through Adenine.
Li et al. (2018) "Expanded Base Editing in Rice and Wheat Using a Cas9-Adenosine Deaminase Fusion," Genome Biol., vol. 19, pp. 1-9.
Ma et al. (2016) "Targeted AID-Mediated Mutagenesis (TAM) Enables Efficient Genomic Diversification in Mammalian Cells," Nature Methods, vol. 13, No., 12, pp. 1029-1035.
Rodriguez-Leal et al. (2017) "Engineering Quantitative Trait Variation for Crop Improvement by Genome Editing," Cell, vol. 171, pp. 470-480.
Shan et al. (2013) "Rapid and Efficient Gene Modification in Rice and Brachypodium Using TALENs," Mol. Plant, vol. 6, pp. 1365-1368.
Written Opinion of the ISA corresponding to International Patent Application No. PCT/EP2019/080140 dated May 7, 2020.
Xie et al. (2015) "Boosting CRISPR/Cas9 Multiplex Editing Capability with the Endogenous tRNS—Processing System," Proceedings of the National Academy of Sciences, vol. 112, pp. 3570-3575.
Xing et al. (2014) "A CRISPR/Cas9 Toolkit for Multiplex Genome Editing in Plants," BMC Plant Biology, vol. 14, pp. 1-12.
Yan et al. (2018) "Highly Efficient A•T to G•C Base Editing by Cas9n-Guided tRNA Adenosine Deaminase in Rice," Molecular Plant, vol. 11, No. 4, pp. 631-634.
Zong et al. (2018) "Efficient C-to-T Base Editing in Plants Using a Fusion of nCas9 and Human APOBEC3A," Nature Biotechnology, vol. 36, No. 10, pp. 950-953.

*Primary Examiner* — Jeremy C Flinders
(74) *Attorney, Agent, or Firm* — Jenkins, Taylor & Hunt, P.A.

(57) ABSTRACT
The present invention relates to novel methods for discovering traits and generating cellular systems having improved phenotypes. In particular, the present invention provides methods for the development of plants having agronomically optimized phenotypes by using targeted mutagenesis with few or no off-target effects. Targeted mutagenesis is achieved by the introduction of a base editor complex or of a STEME complex comprising an array of guide RNAs targeting a nucleic acid sequence of interest. The present invention also relates to cellular systems obtained by the methods described herein and to the use of a base editor complex or the STEME complex comprising an array of guide RNAs for generating a cellular system having an agronomically important phenotype and for identification of an agronomically important phenotype.

23 Claims, 9 Drawing Sheets
Specification includes a Sequence Listing.

STEME-NG

APOBEC3A | 48aa | ecTadA | 32aa | ecTadA7.10 | 32aa | nCas9-NG (D10A) | NLS | UGI | NLS | CaMV Term

Fig. 5A

```
OsACC   GPLHGVALNNPYQPLSVIDLKRCSARNNRTTYCYDFPLAFETAVRKSWSSSTSGASKGVE   1704
ScACC   ------PIATPYPVKEWLQPKRYKAHLMGTTYVYDFPELFRQASSSQWKNFSADVK----   1531
              : .**    . .:: ** .*:   *** ****  *. *   ..*.. ::...

OsACC   NAQCYVKATELVFADKHGSWGTPLVQMDRPAGLNDIGMVAWTLKMSTPEFPSGREIIVVA   1764
ScACC   LTDDFFISNELI-ED----ENGELTEVEREPGANAIGMVAFKITVKTPEYPRGRQFVVVA   1586
              :: :. :.**:    *      . *.::* *  * ****:.:.:.**:* **::***

OsACC   NDITFRAGSFGPREDAFFEAVTNLACEKKLPLIYLAANSGARIGIADEVKSCFRVGWSDD   1824
ScACC   NDITFKIGSFGPQEDEFFNKVTEYARKRGIPRIYLAANSGARIGMAEEIVPLFQVAWNDA   1646
        *****: *****:** **: **: * :: :* *************:*:*:   *:*.*.*

S1886F
OsACC   GSPERGFQYIYLSEEDYARIGTS----VIAHKMQLDSGEIRWVID⌐S⌐VVGKEDGLGVENIH   1880
ScACC   ANPDKGFQYLYLTSEGMETLKKFDKENSVLTERTVINGEERFVIK⌐T⌐IGSEDGLGVECLR   1706
        ..*::****:**:.*.   :  .    :  : :  .** *:**.⌐.⌐:*.******* ::

A1884P                                      P1927F
OsACC   GSA⌐A⌐IASAYSRAYKETFTLTFVTGRTVGIGAYLARLGIRCIQRLDQ⌐P⌐IILTGYSALNKLL   1940
ScACC   GSG⌐L⌐IAGATSRAYHDIFTITLVTCRSVGIGAYLVRLGQRAIQVEGQ⌐P⌐IILTGAPAINKML   1766
        **.⌐.⌐**.* ****:: **:*:** *:******* .*** *.**   .*⌐*⌐*****  *:**:*

OsACC   GREVYSSHMQLGGPKIMATNGVVHLTVSDDLEGVSNILRWLSYVPAYIGGPLPVTTPLDP   2000
ScACC   GREVYTSNLQLGGTQIMYNNGVSHLTAVDDLAGVEKIVEWMSYVPAKRNMPVPILETKDT   1826
        *****:*::**** :** .*** ***..***.**::*:.*:*****   . *.:*:    *

OsACC   PDRPVAYIPENSC--DPRAAIRGVDDSQGKWLGGMFDKDSFVETFEGWAKTVVTGRAKLG   2058
ScACC   WDRPVDFTPTNDETYDVRWMIEGRE--TESGFEYGLFDKGSFFETLSGWAKGVVVGRARLG   1885
         **** : * *,   * *  *.* : ::. :  *:***.**.**:.**** **.***:**

OsACC   GIPVGVIAVETQTMMQTIPADPGQLDSREQSVPRAGQV⌐W⌐FPDSATKTAQALLDFNR-EGL   2117
ScACC   GIPLGVIGVETRTVENLIPADPANPNSAETLIQEPGQV⌐W⌐HPNSAFKTAQAINDFNNGEQL   1945
        ***:***.***:*: : *****.: :* *  .***⌐*⌐.*:** *****: *** * *

W2125C
OsACC   PLFILAN⌐W⌐RGFSGGQRDLFEGILQAGSTIVENLRTYNQPAFVYIPMAAELRGGAWVVVDS   2177
ScACC   PMMILAN⌐W⌐RGFSGGQRDMFNEVLKYGSFIVDALVDYKQPIIIYIPPTGELRGGSWVVVDP   2005
        *::****⌐*⌐********:*::. :*: ** **: *  *:** ::*** :.****:*****

OsACC   KINPDRIECYAERTAKGNVLEPQGLIEIKFRSEELQDCMSRLDPTLIDLKAKLEVANKNG   2237
ScACC   TINADQMEMYADVNARAGVLEPQGMVGIKFRREKLLDTMNRLDDKYRELRSQLSNKSLAP   2065
        .** *::* **: .*:..****** *** *:* * *.*** . :*::::*. .

OsACC   SADTKSLQENIEARTKQLMPLYTQIAIRFAELHDTSLRMAAKGVIKKVVDWEESRSFFYK   2297
ScACC   -EVHQQISKQLADRERELLPIYGQISLQFADLHDRSSRMVAKGVISKELEWTEARRFFFW   2124
         :.:.::   * ::*:*:* **:**.*.:*:*.*:*.*:  * ** *:* *:* **:

OsACC   RLRRRISEDVLAKEIRAVAGEQFSHQPAIELIKKWYSASHAAEWDDDDAFVAWMDNPENY   2357
ScACC   RLRRRLNEEYLIKRLSHQVGEAS-RLEKIARIRSWYPASVDH--EDDRQVATWIEE--NY   2179
        ****:.*: * *.:  .** :  .** : *  *:.** ** ..:*::: **

OsACC   KDYIQYLKA---QRVSQSLSSLSDSSSDLQALPQGLSMLLDKMDPSRRAQLVEEIRKVLG   2414
ScACC   KTLDDKLKGLKLESFAQDLAKKI--RSDHDNAIDGLSEVIK-------------------   2233
        *   : **.  : .:*.*:.    ** :  :*** ::.
```

*Fig. 6*

TARGETED MUTAGENESIS USING BASE EDITORS

TECHNICAL FIELD

The present invention relates to novel methods for discovering traits and generating cellular systems having improved phenotypes. In particular, the present invention provides methods for the development of plants having agronomically optimized phenotypes by using targeted mutagenesis with few or no off-target effects. Targeted mutagenesis is achieved by the introduction of a base editor complex comprising an array of guide RNAs targeting a nucleic acid sequence of interest. A nucleic acid sequence of interest is a genomic sequence associated with an agronomically important trait such as stress resistance or high yield. The present invention also relates to cellular systems obtained by the methods described herein and to the use of a base editor complex comprising an array of guide RNAs for generating a cellular system having an agronomically important phenotype and for identification of an agronomically important phenotype.

BACKGROUND OF THE INVENTION

Induced mutagenesis has been a valuable source of genetic variation for trait discovery in plants and animals for decades. Older techniques such as chemical- or radiation-induced mutagenesis are laborious due to the low density of mutations (Tadele, Z. (2016). Mutagenesis and TILLING to dissect gene function in plants. Current genomics, 17(6), 499-508.) that occur, requiring screening of thousands or millions of individuals to find a few mutations in the gene of interest. It is practically impossible to achieve a high density of de novo mutations in a single gene with these methods, and they are further problematic because of mutations scattered randomly throughout the genome, complicating the identification of the underlying genetics for a trait of interest.

Thus, there is a need for improved mutagenesis techniques to accelerate trait discovery in plants and animals. Rodriguez-Leal et al., 2017 (Rodríguez-Leal, Daniel, et al. 2017. 'Engineering Quantitative Trait Variation for Crop Improvement by Genome Editing', Cell, 171: 470-80.e8.), describe a CRISPR/Cas9 based tool targeted to regulatory genomic regions for generating a deletion mutant population to explore how diverse cis-regulatory alleles influence quantitative traits. The described method uses a plurality of gRNAs to target the CRISPR/Cas9 complex to the desired region, where it introduces multiple double strand breaks. The results indicate that sequence rearrangements and large deletions of up to several thousand base pairs are introduced by this method.

A cell outside the S/G2 cell cycle phases responds to the introduction of a double strand break (DSB) at a genomic locus mostly by engaging non-homologous end joining (NHEJ) repair pathways. While these mechanisms usually simply rejoin the two ends, in the presence of a CRISPR/Cas9 system, the DSB is repeatedly reintroduced making it more likely that insertions and deletions (indels) occur. If several sites are targeted within a genomic locus using a plurality of gRNAs, an accumulation of indels and a complete disruption of the locus can be expected which results in a shutdown of a gene when the locus is a coding area.

In order to identify combinations of mutations, which might improve a certain trait, it is therefore highly desirable to perform a targeted mutagenesis without introducing DSBs and thus to cause trackable sequence modifications, which do not completely disrupt the target locus.

Base editors, including BEs (base editors mediating C to T conversion) and ABEs (adenine base editors mediating A to G conversion), are powerful tools to introduce direct and programmable mutations without the need for double-stranded cleavage (Komor et al., Nature, 2016, 533(7603), 420-424; Gaudelli et al., Nature, 2017, 551, 464-471). In general, base editors are composed of at least a DNA targeting module and a catalytic domain that deaminates cytidine or adenine. All four transitions of DNA (A-T to G-C and C-G to T-A) are possible as long as the base editors can be guided to the target site. Originally developed for working in mammalian cell systems, both BEs and ABEs have been optimized and applied in plant cell systems. Efficient base editing has been shown in multiple plant species (Zong et al., Nature Biotechnology, vol. 25, no. 5, 2017, 438-440; Yan et al., Molecular Plant, vol. 11, 4, 2018, 631-634; Hua et al., Molecular Plant, vol. 11, 4, 2018, 627-630).

Base editors have been used to introduce specific, directed substitutions in genomic sequences with known or predicted phenotypic effects in plants and animals. Furthermore, base editors have been used for targeting multiple sites within a genetic locus in mammalian cells (Ma Y et al. (2016), Targeted AID-mediated mutagenesis (TAM) enables efficient genomic diversification in mammalian cells, Nature Methods 13, 1029-1035; and Hess G T et al. (2016), Directed evolution using dCas9-targeted somatic hypermutation in mammalian cells, Nature Methods 13, 1036-1042), but so far they have not been used for directed mutagenesis targeting multiple sites within a genetic locus or several loci to identify novel or optimized traits in plants.

It was an object of the present invention to provide means and methods to perform a targeted, density-tunable mutagenesis in one or more genomic locus/loci of interest, which allows to identify specific combinations of mutations that cause an improved phenotype.

It was also an object of the present invention, that the means and methods should be targeted specifically to a certain locus or certain loci but not introduce off-target mutations in other genomic regions. Furthermore, no double strand breaks should be introduced to avoid accumulations of indels.

The methods should be usable for a wide range of applications exploring both gene coding sequences and gene regulatory elements such as promoters, terminators, suppressors, and enhancers.

It was a further object of the present invention to provide means and methods to generate modified cellular systems having optimized traits, which provide an improved agricultural performance.

SUMMARY OF THE INVENTION

According to a first aspect of the present invention, the above objectives are met by a method of identifying an agronomically important phenotype in a cellular system, comprising the following steps:

(a) selecting at least one nucleic acid sequence of interest in the genetic material of the cellular system;

(b) providing at least one base editor complex, or a sequence encoding the same, wherein the at least one base editor complex comprises an array of guide RNAs, or a sequence encoding the same, targeting the at least one nucleic acid sequence of interest; or providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest;

(c) introducing the at least one base editor complex, or the sequence encoding the same, or the at least one saturated targeted endogenous mutagenesis editor (STEME) complex, or a sequence encoding the same into the cellular system;

(d) obtaining a cellular system comprising at least one modification in the at least one nucleic acid sequence of interest;

(e) cultivating the cellular system under conditions to obtain a M0 population of the cellular system;

(f) screening the M0 population of the cellular system for the agronomically important phenotype associated with the at least one modification in the at least one nucleic acid sequence of interest; and (g) identifying and thereby selecting an agronomically important phenotype in the cellular system, wherein the array of guide RNAs of the at least one base editor complex comprises at least two guide RNA molecules, or a sequence encoding the same, targeting the at least one nucleic acid sequence of interest; and wherein the array of guide RNAs of the at least one STEME complex comprises at least one guide RNA molecules, or a sequence encoding the same, targeting the at least one nucleic acid sequence of interest.

According to a further aspect, the present invention relates to a method of identifying an agronomically important phenotype in a cellular system, comprising the following steps:

(a) selecting at least one nucleic acid sequence of interest in the genetic material of the cellular system;

(b) providing at least one base editor complex, or a sequence encoding the same, wherein the at least one base editor complex comprises an array of guide RNAs, or a sequence encoding the same, targeting the at least one nucleic acid sequence of interest; or providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest;

(c) introducing the at least one base editor complex, or the sequence encoding the same, or the at least one saturated targeted endogenous mutagenesis editor (STEME) complex, or a sequence encoding the same into the genetic material of the cellular system;

(d) cultivating the cellular system under conditions to obtain a M0 population of the cellular system;

(e) crossing the M0 population of the cellular system with a wildtype population of the cellular system comprising the at least one nucleic acid sequence of interest to obtain a progeny population of the cellular system;

(f) obtaining a progeny population of the cellular system having at least one modification in the at least one nucleic acid sequence of interest;

(g) screening the progeny population of the cellular system for the agronomically important phenotype associated with at the least one modification in the at least one nucleic acid of interest; and (h) identifying and thereby selecting an agronomically important phenotype in the cellular system, wherein the array of guide RNAs of the at least one base editor complex comprises at least two guide RNA molecules, or a sequence encoding the same, targeting the at least one nucleic acid sequence of interest; and wherein the array of guide RNAs of the at least one STEME complex comprises at least one guide RNA molecules, or a sequence encoding the same, targeting the at least one nucleic acid sequence of interest.

According to yet a further aspect, the present invention relates to a method of generating a modified cellular system having an agronomically important phenotype, the method comprises the following steps:

(a) selecting at least one nucleic acid sequence of interest in the genetic material of the cellular system;

(b) providing at least one base editor complex, or a sequence encoding the same, wherein the at least one base editor complex comprises an array of guide RNAs, or a sequence encoding the same, targeting the at least one nucleic acid sequence of interest; or providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest;

(c) introducing the at least one base editor complex, or the sequence encoding the same, or the at least one saturated targeted endogenous mutagenesis editor (STEME) complex, or a sequence encoding the same into the cellular system;

(d) obtaining a cellular system comprising at least one modification in the at least one nucleic acid sequence of interest;

(e) cultivating the cellular system under conditions to obtain a M0 population of the cellular system;

(f) screening the M0 population of the cellular system for the agronomically important phenotype associated with the at least one modification in the at least one nucleic acid sequence of interest; and (g) identifying and thereby selecting a cellular system from the M0 population having the agronomically important phenotype; and (h) obtaining a modified cellular system having the agronomically important phenotype, wherein the array of guide RNAs of the at least one base editor complex comprises at least two guide RNA molecules, or a sequence encoding the same, targeting the at least one nucleic acid sequence of interest; and wherein the array of guide RNAs of the at least one STEME complex comprises at least one guide RNA molecules, or a sequence encoding the same, targeting the at least one nucleic acid sequence of interest.

According to a further aspect, the present invention also relates to a method of generating a progeny of a modified cellular system having an agronomically important phenotype, the method comprises the following steps:

(a) selecting at least one nucleic acid sequence of interest in the genetic material of the cellular system;

(b) providing at least one base editor complex, or a sequence encoding the same, wherein the at least one base editor complex comprises an array of guide RNAs, or a sequence encoding the same, targeting the at least one nucleic acid sequence of interest; or providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest;

(c) introducing the at least one base editor complex, or the sequence encoding the same, or the at least one saturated targeted endogenous mutagenesis editor (STEME) complex, or a sequence encoding the same into the genetic material of the cellular system;

(d) cultivating the cellular system under conditions to obtain a M0 population of the cellular system;

(e) crossing the M0 population of the cellular system with a wildtype population of the cellular system comprising the at least one nucleic acid sequence of interest to obtain a progeny population of the cellular system;

(f) obtaining a progeny population of the cellular system having at least one modification in the at least one nucleic acid sequence of interest;

(g) screening the progeny population of the cellular system for the agronomically important phenotype associated with at the least one modification in the at least one nucleic acid of interest; and (h) identifying and thereby selecting a cellular system from the progeny population having the agronomically important phenotype, (i) obtaining a progeny of a modified cellular system having the agronomically important phenotype, wherein the array of guide RNAs of the at least one base editor complex comprises at least two guide RNA molecules, or a sequence encoding the same, targeting the at least one nucleic acid sequence of interest; and wherein the array of guide RNAs of the at least one STEME complex comprises at least one guide RNA molecules, or a sequence encoding the same, targeting the at least one nucleic acid sequence of interest.

In one embodiment of the various aspects of the present invention, the array of guide RNAs of the at least one base editor complex comprises at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, or more individual guide RNA molecules targeting the at least one nucleic acid sequence of interest.

In one embodiment of the various aspects of the present invention, the array of guide RNAs of the at least one STEME complex comprises at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, or more individual guide RNA molecules targeting the at least one nucleic acid sequence of interest.

In another embodiment of the various aspects of the present invention, the guide RNA molecules target overlapping and/or distinct fragments of the nucleic acid sequence of interest.

In yet another embodiment of the various aspects of the present invention, the at least one base editor complex or a component thereof is introduced as part of at least one plasmid, at least one vector, or at least one linear DNA molecule, as RNA molecule and/or as a preassembled complex of RNA and/or protein.

In one embodiment of the various aspects of the present invention, the at least one STEME complex or a component thereof is introduced as part of at least one plasmid, at least one vector, or at least one linear DNA molecule, as RNA molecule and/or as a preassembled complex of RNA and/or protein.

In a further embodiment of the various aspects of the present invention, the at least one base editor complex or the at least one STEME complex is introduced into the cellular system by biological or physical means, including transfection, transformation, including transformation by *Agrobacterium* spp., preferably *Agrobacterium tumefaciens*, a viral vector, biolistic bombardment, transfection using chemical reagents, including polyethylene glycol transfection, or any combination thereof.

In another embodiment of the various aspects of the present invention, the at least one nucleic acid sequence of interest is/are (an) endogenous gene(s) or genetic element(s) associated with an agronomically important phenotype.

In a further embodiment of the various aspects of the present invention, the endogenous gene(s) described above is/are selected from the group consisting of a gene encoding resistance or tolerance to abiotic stress, including drought stress, osmotic stress, heat stress, cold stress, oxidative stress, heavy metal stress, nitrogen deficiency, phosphate deficiency, salt stress or waterlogging, herbicide resistance, including resistance to glyphosate, glufosinate/phosphinotricin, hygromycin, protoporphyrinogen oxidase (PPO) inhibitors, ALS inhibitors, and Dicamba, a gene encoding resistance or tolerance to biotic stress, including a viral resistance gene, a fungal resistance gene, a bacterial resistance gene, an insect resistance gene, or a gene encoding a yield related trait, including lodging resistance, flowering time, shattering resistance, seed colour, endosperm composition, or nutritional content.

In yet a further embodiment of the various aspects of the present invention, the genetic element(s) described above is/are a DNA encoding a non-coding RNA like rRNA, tRNA, miRNA, siRNA, piRNA, snRNA, snoRNA, lncRNA, antisense-RNA, riboswitches or ribozyme, or a regulatory sequence or at least part of a regulatory sequence, wherein the regulatory sequence or the part thereof comprises at least one of a core promoter sequence, a proximal promoter sequence, a cis regulatory sequence, a trans regulatory sequence, a locus control sequence, an insulator sequence, a silencer sequence, an enhancer sequence, a terminator sequence, and/or any combination thereof.

In another embodiment of the various aspects of the present invention, the at least one modification in the at least one nucleic acid sequence of interest means that the at least one base editor complex or the at least one STEME complex induces at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, or even more nucleotide exchange(s) in the nucleic acid sequence of interest.

In a further embodiment of the various aspects of the present invention, at least one base editor component of the at least one base editor complex or at least one STEME component of the at least one STEME complex comprises at least one nucleic acid recognition domain and at least one nucleic acid editing domain, wherein the at least one nucleic acid recognition domain is independently selected from CRISPR-Cas9, CRISPR-Cpf1, CRISPR-CasX, CRISPR-MAD7, CRISPR-Csm1, CRISPR-Cas9 nickase, CRISPR-Cpf1 nickase, CRISPR-CasX nickase, CRISPR-MAD7 nickase or CRISPR-Csm1 nickase, and wherein the at least one nucleic acid editing domain is independently selected from a cytidine deaminase or a adenine deaminase or both, preferably wherein the at least one nucleic acid editing domain is independently selected from an apolipoprotein B mRNA-editing complex (APOBEC) family de-aminase, preferably a rat-derived APOBEC, an activation-induced cytidine deaminase (AID), an ACF1/ASE deaminase, an ADAT family deaminase, an ADAR2 deaminase, or a PmCDA1 deaminase, a TadA derived deaminase, and/or any combination, variant, or catalytically active fragment thereof, and wherein the at least one base editor component optionally comprises at least one nuclear localization signal, and wherein the at least one base editor component optionally comprises at least one linker sequence, preferably an XTEN linker, and wherein the at least one base editor component optionally comprises at least one component inhibiting naturally occurring DNA or RNA repair, preferably an uracil DNA glycosylase inhibitor (UGI) domain, a Gam protein domain of bacteriophage Mu or an inhibitor of inosine base excision repair domain.

In yet another embodiment of the various aspects of the present invention, the at least one base editor component described above, or the sequences encoding the same, or the at least one STEME component described above, or the sequence encoding the same, is provided as a fusion molecule.

In a further embodiment of the various aspects of the present invention, the components of the base editor complex described above, or the sequences encoding the same, or the components of the STEME complex described above, or the sequences encoding the same, are provided as individual molecules.

In one embodiment of the various aspects of the present invention, the cellular system is selected from a eukaryotic organism, wherein the eukaryotic organism is a plant, part of a plant or a plant cell.

In another embodiment of the various aspects of the present invention, the part of the plant described above is selected from the group consisting of leaves, stems, roots, emerged radicles, flowers, flower parts, petals, fruits, pollen, pollen tubes, anther filaments, ovules, embryo sacs, egg cells, ovaries, zygotes, embryos, zygotic embryos, somatic embryos, apical meristems, vascular bundles, pericycles, seeds, roots, and cuttings. A plant cell as used herein may be a protoplast cell.

In yet another embodiment of the various aspects of the present invention, the plant, part of a plant or plant cell described above is, or originates from, a plant species selected from the group consisting of: *Hordeum vulgare, Hordeum bulbosum, Sorghum bicolor, Saccharum officinarium, Zea mays, Setaria italica, Oryza minuta, Oriza sativa, Oryza australiensis, Oryza alta, Triticum aestivum, Secale cereale, Malus domestica, Brachypodium distachyon, Hordeum marinum, Aegilops tauschii, Daucus glochidiatus, Beta vulgaris, Daucus pusillus, Daucus muricatus, Daucus carota, Eucalyptus grandis, Nicotiana sylvestris, Nicotiana tomentosiformis, Nicotiana tabacum, Solanum lycopersicum, Solanum tuberosum, Coffea canephora, Vitis vinifera, Erythrante guttata, Genlisea aurea, Cucumis sativus, Morus notabilis, Arabidopsis arenosa, Arabidopsis lyrata, Arabidopsis thaliana, Crucihimalaya himalaica, Crucihimalaya wallichii, Cardamine flexuosa, Lepidium virginicum, Capsella bursa pastoris, Olmarabidopsis pumila, Arabis hirsute, Brassica napus, Brassica oeleracia, Brassica rapa, Raphanus sativus, Brassica juncea, Brassica nigra, Eruca vesicaria* subsp. *sativa, Citrus sinensis, Jatropha curcas, Populus trichocarpa, Medicago truncatula, Cicer yama-shitae, Cicer bijugum, Cicer arietinum, Cicer reticulatum, Cicer judaicum, Cajanus cajanifolius, Cajanus scarabaeoides, Phaseolus vulgaris, Glycine max, Astragalus sinicus, Lotus japonicas, Torenia fournieri, Spinacea*

*oleracea, Phaseolus vulgaris, Vicia faba, Allium cepa, Allium fistulosum, Allium sativum,* and *Allium tuberosum.*

In a further aspect, the present invention also relates to a modified cellular system obtained by a method according to any one of the aspects and embodiments described above.

In yet another aspect, the present invention relates to the use of at least one base editor complex comprising an array of guide RNAs targeting at least one nucleic acid sequence of interest in the genetic material of a cellular system for (a) generating a cellular system having an agronomically important phenotype associated with at least one modification in the at least one nucleic acid sequence of interest; and/or (b) identification of an agronomically important phenotype associated with at least one modification in the at least one nucleic acid sequence of interest in the genetic material of the cellular system.

In yet a further aspect, the present invention relates to the use of at least one STEME complex comprising an array of guide RNAs targeting at least one nucleic acid sequence of interest in the genetic material of a cellular system for (a) generating a cellular system having an agronomically important phenotype associated with at least one modification in the at least one nucleic acid sequence of interest; and/or (b) identification of an agronomically important phenotype associated with at least one modification in the at least one nucleic acid sequence of interest in the genetic material of the cellular system.

Figures 1A, 1B, 1C:
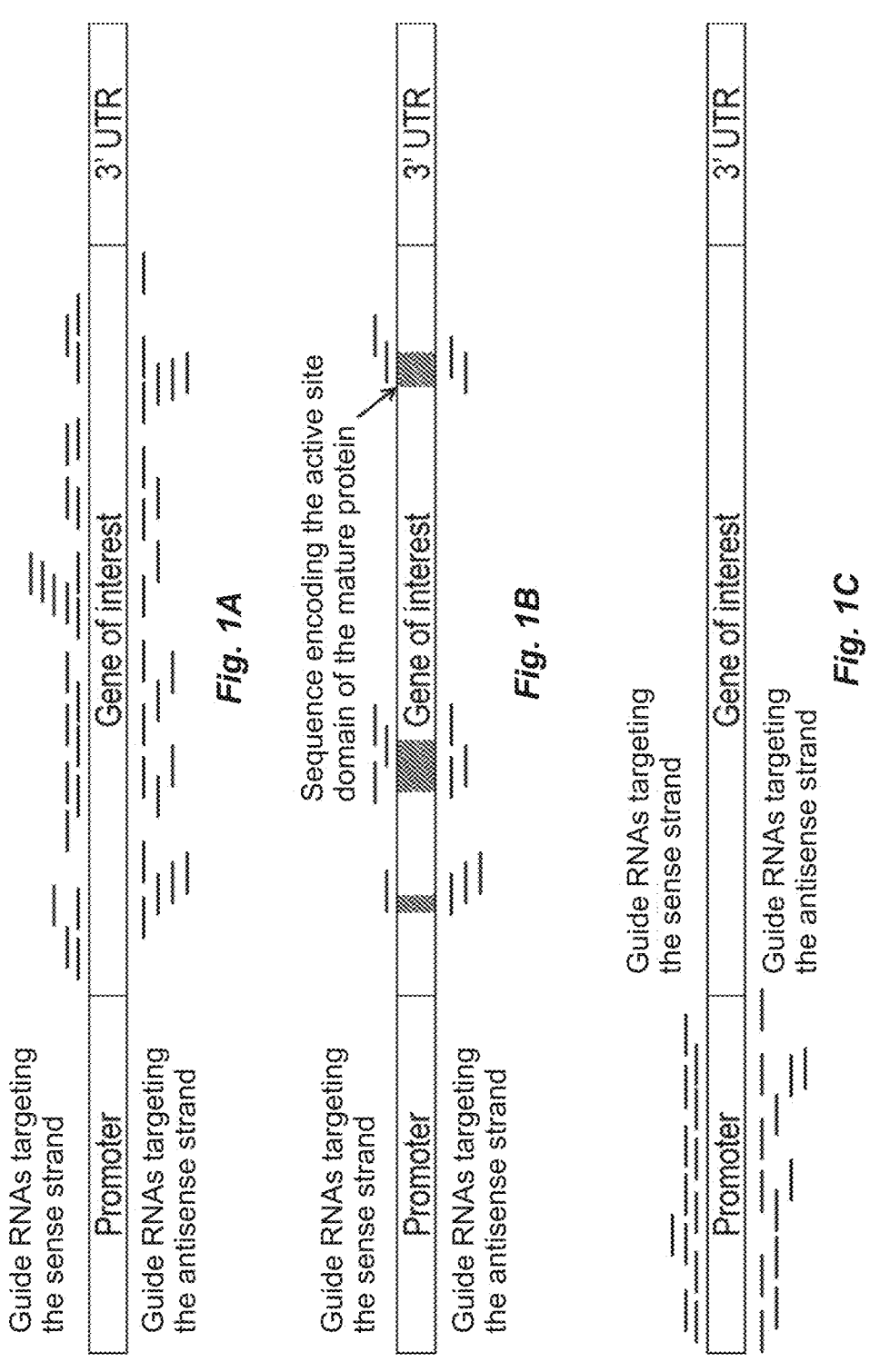
FIG. 1: Schematic view of base editor guide RNAs tiled across coding DNA sequence or promoter sequence for phenotype discovery due to protein mutagenesis and regulatory motif mutagenesis, respectively. (A) Mutagenesis in the coding sequence; (B) Mutagenesis of an active site in the coding sequence; (C) Mutagenesis in the promoter.

An untreated protoplast sample served as control. Values and error bars indicate mean±s.e.m of three independent biological replicates.

FIG. 5. STEME-NG performs saturated mutagenesis in rice protoplasts. (a) Structure of STEME-NG. Abbreviations: ecTadA7.10: evolved *Escherichia coli* TadA; aa: amino acid. (b) An overview of the OsACC protein domains generated by Pfam. Design of sgRNAs with forward direction NGD-3' (D=A, T or G) PAMs, and reverse complement 5'-HCN (H=A, T or C) PAMs. BC-N: biotin carboxylase, N-terminal domain; CPSase_L_D2: carbamoyl-phosphate synthase L chain, ATP binding domain; BC-C: biotin carboxylase, C-terminal domain; BA: biotin-requiring enzyme, the attachment domain binds biotin; ACC central: acetyl-CoA carboxylase, central region; CT: carboxyltransferase domain.

FIG. 6. The sequence alignment of CT domains from rice OsACC (SEQ ID NO: 192) and yeast ScACC (SEQ ID NO: 193). The key residues involved in herbicide binding are colored in red: Y1912, W2097, W2125 and F2128 in rice OsACC, and Y1738, W1924, W1953 and F1956 in yeast ACC. Mutations found in the screen are: S1866F (T1692), A1884P (L1710), P1927F (P1753) and W2125C (W1953).

DEFINITIONS

An "agronomically important phenotype" in the context of the present invention is a phenotype of a plant, which exhibits one or more novel or optimized trait(s) that provide an improved agricultural performance with respect to e.g. yield, architecture, nutrient partitioning, photosynthesis, carbon sequestration, disease resistance, stress tolerance, herbicide tolerance, hormone signaling, and other trait categories.

An agronomically important phenotype may be caused by any one or a combination of one or more mutations in one or more coding or regulatory regions of the genetic material of the plant. The modifications may be associated in terms of spatial proximity or genomic context or they may be completely unrelated. An agronomically important phenotype may thus exhibit one or more polygenic traits.

The term "nucleic acid sequence" used herein refers to single- or double-stranded DNA or RNA of natural or synthetic origin. A nucleic acid molecule or a nucleic acid sequence comprises at least one nucleotide or two or more nucleotides, respectively, in a specific sequence of any length including oligonucleotides or polynucleotides. A nucleic acid sequence may be a coding region or a regulatory region of a gene or a part thereof or comprise one or more genes optionally including regulatory regions.

The term "modifying" or "modification" of a nucleic acid molecule in the context of the present invention refers to a change in a nucleic acid sequence that results in at least one difference in the nucleic acid sequence distinguishing it from the original sequence. In particular, a modification in the context of the present invention is a substitution of one or more nucleobases, which does not require any double strand break in the DNA to be modified.

A "cellular system" as used herein refers to at least one element comprising all or part of the genome of a cell of interest to be modified. The cellular system may thus be any in vivo or in vitro system, including also a cell-free system. The cellular system comprises the target genome or genomic sequence to be modified in a suitable way, i.e., in a form accessible to a genetic modification or manipulation. The cellular system may be selected from, for example, a prokaryotic or eukaryotic cell, including an animal or a plant cell, or the cellular system may comprise a genetic construct comprising all or parts of the genome of a prokaryotic or eukaryotic cell to be modified in a highly targeted way. The cellular system may be provided as isolated cell or vector, or the cellular system may be comprised by a network of cells in a tissue, organ, material or whole organism, either in vivo or as isolated system in vitro. In this context, the "genetic material" of a cellular system can thus be understood as all, or part of the genome of an organism the genetic material of which organism as a whole or in part is present in the cellular system to be modified. Preferably, "cellular system" in the context of the present invention refers to cells, an organism or a part or a tissue of an organism, preferably a plant or a plant line, a plant part or a plant organ, differentiated and undifferentiated plant tissues, plant cells, seeds, and derivatives and progeny thereof.

A "base editor" as used herein refers to a deaminase protein or a complex comprising at least one protein or a fragment thereof having the capacity to mediate a targeted base modification, i.e., the conversion of a base of interest resulting in a point mutation of interest. Preferably, the at least one base editor in the context of the present invention comprises at least one nucleic acid recognition domain for targeting the base editor to a specific site of a nucleic acid sequence and at least one nucleic acid editing domain, which performs the conversion of at least one nucleobase at the specific target site. The base editor may comprise further components besides the nucleic acid recognition domain and the nucleic acid editing domain, such as spacers, localization signals and components inhibiting naturally occurring DNA or RNA repair mechanisms to ensure the desired editing outcome. A "saturated targeted endogenous mutagenesis editor (STEME)" as used herein refers to a fusion deaminase protein combining a cytidine deaminase and an adenosine deaminase. In addition to the fusion deaminase, the STEME may contain a CRISPR nickase like nCas9 (D10A) and uracil DNA glycosylase inhibitor (UGI) (FIG. 1a). Preferably, the at least one STEME in the context of the present invention comprises at least one nucleic acid recognition domain for targeting the base editor to a specific site of a nucleic acid sequence and at least one nucleic acid editing domain, which performs the conversion of at least one nucleobase at the specific target site. The STEME may comprise further components besides the nucleic acid recognition domain and the nucleic acid editing domain, such as spacers, localization signals and components inhibiting naturally occurring DNA or RNA repair mechanisms to ensure the desired editing outcome.

The term "nucleic acid recognition domain" refers to the component of the base editor, which ensures the site-specificity of the base editor by directing it to a target site within the predetermined location. A nucleic acid recognition domain may be based on a CRISPR system, which specifically recognizes a target sequence within the nucleic acid molecule of the cellular system using a guide RNA (gRNA) or single guide RNA (sgRNA), may be a synthetic fusion of a CRISPR RNA (crRNA) and a trans-activating crRNA (tracrRNA).

A "CRISPR system" refers to any naturally occurring system comprising a CRISPR nuclease, which has been isolated from its natural context, and which preferably has been modified or combined into a recombinant construct of interest to be suitable as tool for targeted genome engineering. Any CRISPR nuclease can be used and optionally reprogrammed or additionally mutated to be suitable for the various embodiments according to the present invention as long as the original wild-type CRISPR nuclease provides for DNA recognition, i.e., binding properties. Said DNA recognition can be PAM (protospacer adjacent motif) dependent. CRISPR nucleases having optimized and engineered PAM recognition patterns can be used and created for a specific application. The expansion of the PAM recognition code can be suitable to target site-specific effector complexes to a target site of interest, independent of the original PAM specificity of the wild-type CRISPR-based nuclease. CRISPR nucleases also comprise mutants or catalytically active fragments or fusions of naturally occurring CRISPR effector sequences, or the respective sequences encoding the same. A CRISPR nuclease may in particular also refer to a CRISPR nickase or even a nuclease-deficient variant of a CRISPR polypeptide having endonucleolytic function in its natural environment.

The term "nucleic acid editing domain" refers to the component of the base editor or the STEME, which initiates the nucleotide conversion to result in the desired edit. The catalytic function of the nucleic acid editing domain may be a cytidine deaminase function or an adenine deaminase function, or both.

The base editor represents a component of a "base editor complex", which additionally comprises an array of gRNAs. An "array of gRNAs" refers to two or preferably more gRNAs, which have been designed to target one specific nucleic acid sequence each.

The STEME represents a component of a "STEME complex", which additionally comprises an array of gRNAs. An "array of gRNAs" refers to one gRNA or preferably one or more gRNAs, which have been designed to target one specific nucleic acid sequence each.

An "M0 population" refers to a number of individuals of a cellular system, which are obtained by cultivation after mutagenesis in the cellular system. The M0 population exhibits a diversity of different modifications in the nucleic acid sequence of the genetic material, which was targeted in the mutagenesis. In contrast, a "M1 population" is obtained by crossing an M0 population. In the context of the present invention, the M0 population obtained by cultivation after mutagenesis is preferably crossed with a wildtype cellular system or a wildtype population.

DETAILED DESCRIPTION

This invention provides a method using base editors to cause targeted, ultra-high density, de novo mutagenesis in a single gene of interest (or a small number of genes of interest) and subsequently screening the mutagenized population for novel or optimized traits. Few—if any—or no off-target effects can be expected in regions other than the target region(s) and the risk of introducing undesired indels is minimized. The approach allows to fine-tune the density of mutations depending on the target sequence(s) and the desired diversity.

The methods described herein can be used in any situation where a large amount of high density genetic variation may be of value in discovering new or optimized traits. In plants this can include yield, morphology, architecture, nutrient partitioning, photosynthesis, carbon sequestration, disease resistance, stress tolerance, herbicide tolerance, hormone signaling, fertility, and other trait categories.

In a first aspect of the present invention, a method is provided for identifying an agronomically important phenotype in a cellular system, comprising the following steps:
  (a) selecting at least one nucleic acid sequence of interest in the genetic material of the cellular system;

(b) providing at least one base editor complex, or a sequence encoding the same, wherein the at least one base editor complex comprises an array of guide RNAs, or a sequence encoding the same, targeting the at least one nucleic acid sequence of interest; or providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest;

(c) introducing the at least one base editor complex, or the sequence encoding the same, or the at least one saturated targeted endogenous mutagenesis editor (STEME) complex, or a sequence encoding the same, into the cellular system;

(d) obtaining a cellular system comprising at least one modification in the at least one nucleic acid sequence of interest;

(e) cultivating the cellular system under conditions to obtain a M0 population of the cellular system;

(f) screening the M0 population of the cellular system for the agronomically important phenotype associated with the at least one modification in the at least one nucleic acid sequence of interest; and (g) identifying and thereby selecting an agronomically important phenotype in the cellular system, wherein the array of guide RNAs comprises at least two guide RNA molecules, or a sequence encoding the same, targeting the at least one nucleic acid sequence of interest; and wherein the array of guide RNAs of the at least one STEME complex comprises at least one guide RNA molecules, or a sequence encoding the same, targeting the at least one nucleic acid sequence of interest.

In order to identify an agronomically important phenotype, which exhibits one or more improved or new traits, nucleic acid sequences of interest may be selected in step (a), in which sequence diversity can be expected to produce useful phenotypes. Of particular interest may be genes or other genomic elements, in which sequence diversity has been shown to affect valuable phenotypes but where the full range of potential sequence diversity has not yet been explored. This applies to the vast majority of important traits in agriculture since it has not been possible to date to perform target-specific density-tuneable mutagenesis without introducing off-target effects and avoid insertion/deletion (InDel) formation. However, in order to discover new traits or new ways to improve traits it may also be of interest to target sequences, which are not known to have an influence on certain phenotypes.

Nucleic acid sequences of interest may include all portions of gene coding sequences, DNA sequences encoding non-coding RNAs like rRNA, tRNA, miRNA, siRNA, piRNA, snRNA, snoRNA, lncRNA, antisense-RNA, riboswitches or ribozyme, or regulatory elements such as promoters, terminators, enhancers or suppressors. Any of these elements may be targeted separately or in combination. Advantageously, the method of the present invention also allows to identify phenotypes, which are caused by combinations of mutations in seemingly unrelated genomic regions, e.g. polygenic traits.

For targeting the selected nucleic acid sequence(s) of interest, an array of gRNAs is designed. The array of gRNAs determines the region(s), which undergo high density mutagenesis. Notably, within a nucleic acid of interest, which codes for a certain protein, the sequence encoding the active site of the protein may or may not be targeted depending on the desired outcome (FIGS. 1A and 1B). The gene target and specific feature of the gene to be mutagenized depends upon what type of genetic diversity is expected to produce the phenotypes of interest. For example, a preferred design may be to target sequences encoding the active site of a plant enzyme for mutagenesis, in order to produce structural and chemical diversity in the active site of that enzyme (FIG. 1B). Another design may target a promoter region of the target gene (FIG. 1C). It is likely that many different gRNA arrays may be useful against a single genomic target in order to preferentially obtain different mutagenesis profiles. Specific gRNAs give rise to little or no potential off-target effects. However, even if off-target effects are observed, which cause problems for the desired phenotype, these mutants will not be selected in the screening.

The design of the array depends on the size of the target region and the desired mutation density, which e.g. may vary with different target genes. If the coding sequence is the targeted area, focus is given on the first and/or the second nucleobase. It is possible that the same nucleobase is mutated into different nucleobases. For example, the cytidine deaminase based base editor mainly converts C to T, but it can also produce C to A or C to G by-products at lower frequency.

Mutagenesis is performed within an editing window, i.e. the section of the target region, in which nucleotides are edited. The size and position of the editing window is determined by the base editor. For example, using different deaminases can result in different editing windows. A base editor may also comprise more than one deaminase domain which may be linked with each other by techniques commonly known in the art and thereby affecting the size and position of the editing window. The STEME are such deaminase fusion protein comprising more than one deaminase domain, preferably at least one cytidine deaminase domain and at least one adenine deaminase domain. Outside of the editing window, no bases will be edited usually. For example, in the BE-PLUS system, 10 APOBEC domain can be recruited to one dCas9 domain and in the CRISPR-X system, 4 AID domain can be recruited to one dCas9 domain.

Figure 2B:
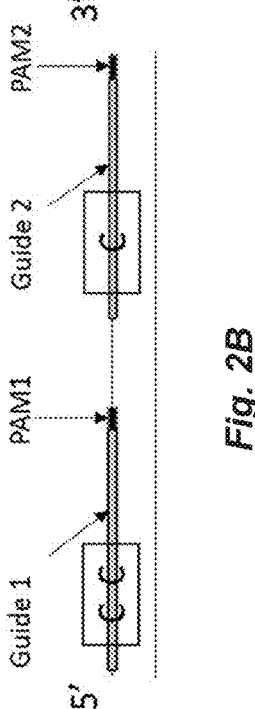
FIG. 2: Schematic representation of editing window(s) for a cytidine (C) base editor (BE). The editing window(s) are represented by rectangular boxes. (A) Two close-by C's can be edited within one editing window targeted by one gRNA. (B) One gRNA (Guide 1) targets two C's within one editing window and another gRNA (Guide 2) targets one C within another editing window at a different location. The protospacer adjacent motif (PAM) is represented in black.
Figure 2A:
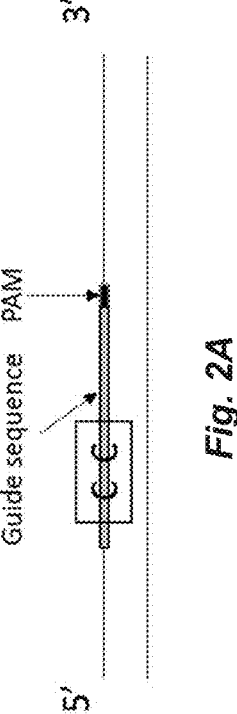

If multiple sites desired to be edited are close by, within the editing window, this can be achieved by using a single gRNA (FIG. 2A). If the sites to be edited are further away from each other, multiple gRNAs can be delivered so that base editors are targeted to different locations and editing in these different locations can be achieved (FIG. 2B). The freedom to target any site or multiple sites is limited only by the presence of a suitable PAM and the editing window of the base editor or of the STEME.

Within the editing window, there may be several targets for the specific base editor used. In this case all targets may be edited or only one or a few. Furthermore, as mentioned above, the same nucleobase may be mutated into different nucleobases. Thus, it is possible to create a high diversity of base edits by the method of the present invention and discover novel and improved traits.

It may be appropriate to regenerate or implant the cell into a whole organism for phenotypic screening. It is important to screen a sufficiently large population to ensure that the full range of possible mutagenesis diversity is assessed. The complexity of the possible mutagenesis outcomes is directly determined by the number of phenotype-affecting changes which is a function of the base editor or STEME target density, of the specific characteristics of the base editor or STEME and of the number of base conversions that would lead to an impact on the phenotype. It is very important to consider the range and frequency of possible mutagenesis outcomes, and screen a population of sufficient size. In general, the greater number of targets, the greater the population size should be.

Furthermore, the population size is dependent on the trait and its possibility for phenotyping. In general, the size of the target area and the desired mutation density dictates the number of gRNAs needed, which also determines the population size for screening. Larger target area and high density of desired mutation requires more gRNAs and larger population size.

Base editing can generate homozygous mutations or biallelic mutations. Otherwise homozygous plants may be obtained through selfing. Sensitized genetic screening can be used as described in Rodriguez-Leal et al., 2017 (Rodríguez-Leal, Daniel, et al. 2017. 'Engineering Quantitative Trait Variation for Crop Improvement by Genome Editing', Cell, 171: 470-80.e8.).

Several strategies are available by which mutagenized populations can be generated for screening. In plants, one strategy is to deliver a single or multiple DNA molecules harboring expression cassettes for the base editor and the guide RNAs or the STEME and the guide RNAs to cells or tissue, and then apply a regeneration process that would produce hundreds or thousands of unique M0 plants. This population of M0 plants, or their progeny, would be screened for phenotype. The disadvantage of this approach is that the labor involved in generating such a large number of M0 plants makes it practically difficult, and in some cases, actually impossible to achieve in species that do not have extremely efficient DNA delivery, selection, and regeneration systems.

An alternative to this method is to generate a handful of M0 plants harboring the complete set of base editor and guide RNA expression cassettes or the complete set of STEME and guide RNA expression cassettes. These plants, or their progeny, are then crossed to other plants to generate large numbers of progeny, and the progeny population is screened for the phenotype. Although this method requires more time due to the at least one additional generation required to produce the screening population, the labor requirement is substantially lower due to the ease of crossing plants to produce large populations compared to regenerating large populations of plants.

Therefore, in another aspect, the present invention provides a method of identifying an agronomically important phenotype in a cellular system, comprising the following steps:

(a) selecting at least one nucleic acid sequence of interest in the genetic material of the cellular system;

(b) providing at least one base editor complex, or a sequence encoding the same, wherein the at least one base editor complex comprises an array of guide RNAs, or a sequence encoding the same, targeting the at least one nucleic acid sequence of interest; or providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest;

(c) introducing the at least one base editor complex, or the sequence encoding the same, or the at least one saturated targeted endogenous mutagenesis editor (STEME) complex, or a sequence encoding the same, into the genetic material of the cellular system;

(d) cultivating the cellular system under conditions to obtain a M0 population of the cellular system;

(e) crossing the M0 population of the cellular system with a wildtype population of the cellular system comprising the at least one nucleic acid sequence of interest to obtain a progeny population of the cellular system;

(f) obtaining a progeny population of the cellular system having at least one modification in the at least one nucleic acid sequence of interest;

(g) screening the progeny population of the cellular system for the agronomically important phenotype associated with at the least one modification in the at least one nucleic acid of interest; and (h) identifying and thereby selecting an agronomically important phenotype in the cellular system, wherein the array of guide RNAs comprises at least two guide RNA molecules, or a sequence encoding the same, targeting the at least one nucleic acid sequence of interest; and wherein the array of guide RNAs of the at least one STEME complex comprises at least one guide RNA molecules, or a sequence encoding the same, targeting the at least one nucleic acid sequence of interest.

In the method described above, a population is generated by outcrossing and the action of base editing on the wildtype copy of the genome from the cross. Using this method, large mutant populations can be produced of basically any plant species for screening.

The present invention also relates to a method of generating a modified cellular system having an agronomically important phenotype. Using base editors or STEMEs to cause targeted mutagenesis in a single gene of interest (or a small number of genes of interest) allows to generate phenotypes with novel or optimized traits such as improved yield, disease resistance, stress tolerance, herbicide tolerance and other trait categories. Due to the target-specificity of the approach and the avoidance of double strand breaks, few—if any—or no off-target effects or InDel formations are observed.

According to a further aspect, the present invention therefore provides a method of generating a modified cellular system having an agronomically important phenotype, the method comprises the following steps:

(a) selecting at least one nucleic acid sequence of interest in the genetic material of the cellular system;

(b) providing at least one base editor complex, or a sequence encoding the same, wherein the at least one base editor complex comprises an array of guide RNAs, or a sequence encoding the same, targeting the at least one nucleic acid sequence of interest; or providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest;

(c) introducing the at least one base editor complex, or the sequence encoding the same, or the at least one saturated targeted endogenous mutagenesis editor (STEME) complex, or a sequence encoding the same, into the cellular system;

(d) obtaining a cellular system comprising at least one modification in the at least one nucleic acid sequence of interest;

(e) cultivating the cellular system under conditions to obtain a M0 population of the cellular system;

(f) screening the M0 population of the cellular system for the agronomically important phenotype associated with the at least one modification in the at least one nucleic acid sequence of interest; and (g) identifying and thereby selecting a cellular system from the M0 population having the agronomically important phenotype; and (h) obtaining a modified cellular system having the agronomically important phenotype, wherein the array of guide RNAs comprises at least two guide RNA molecules, or a sequence encoding the same, targeting the at least one nucleic acid sequence of interest; and wherein the array of guide RNAs of the at least one STEME complex comprises at least one guide RNA molecules, or a sequence encoding the same, targeting the at least one nucleic acid sequence of interest.

The agronomically important phenotype may have been previously identified using a method to identify an agronomically important phenotype as described above. Thus, the nucleic acid sequence(s) of interest to be targeted may already be known or it may be known from other sources that mutation(s) in one or more nucleic acid sequence(s) in the genetic material have an impact on the desired agronomically important phenotype.

The agronomically important phenotype may be caused by mutations in any portions of gene coding sequences, DNA sequences encoding non-coding RNA or regulatory elements such as promoters, terminators or suppressors. Thus, any of these elements may be targeted separately or in combination. Advantageously, the method of the present invention also allows to generate phenotypes, which are caused by combinations of mutations in distant genomic regions (e.g. polygenic traits) by specifically targeting all of these regions.

In case of the base editor complex an array of at least two but likely more gRNAs is designed for targeting the selected nucleic acid sequence(s) of interest, in case of the STEME complex an array of at least one or solely one, but likely more gRNAs is designed for targeting the selected nucleic acid sequence(s) of interest. If it is known precisely, where mutations are required to generate the agronomically important phenotype, the gRNA(s) can be specifically designed to target these sites. As already described above in the context of the methods of identifying an agronomically important phenotype, the skilled person is aware of which base editors to use to target certain nucleotides and of how to adjust the size and position of the editing window(s). If the coding sequence is the targeted area, focus is given on the first and/or the second nucleobase. For example, using base editors with cytidine deaminase, C's are targets mainly resulting in C to T conversion as the main product. However, as already mentioned above, side-products may be formed, which may or may not result in the desired phenotype. Furthermore, not all target nucleotides within the editing window may be converted, which again may or may not result in the desired phenotype. Therefore, to sort out the mutants, which do not provide the desired phenotype, the M0 population is screened for the phenotype and the mutants are selected accordingly.

After mutagenesis, the cellular system is cultivated to obtain a M0 population for screening. As already described above in the context of the methods for identifying an agronomically important phenotype, the population size needs to be adjusted for screening depending on the target(s) of the mutagenesis.

To generate mutagenized populations for screening, a single or multiple DNA molecules harboring expression cassettes for the base editor and the guide RNAs may be delivered to cells or tissue, and then a regeneration process may be applied that would produce hundreds or thousands of unique M0 plants. This population of M0 plants, or their progeny, would be screened for phenotype.

As already mentioned above, the disadvantage of this approach is that the labor involved in generating such a large number of M0 plants makes it practically difficult, and in some cases, actually impossible to achieve in certain species. Therefore, alternatively, a handful of M0 plants harboring the complete set of base editor/STEME and guide RNA expression cassettes may be generated and crossed to other plants to generate large numbers of progeny, and the progeny population is screened for the phenotype.

Therefore, in another aspect, the present invention provides a method of generating a progeny of a modified cellular system having an agronomically important phenotype, the method comprises the following steps:

(a) selecting at least one nucleic acid sequence of interest in the genetic material of the cellular system;

(b) providing at least one base editor complex, or a sequence encoding the same, wherein the at least one base editor complex comprises an array of guide RNAs, or a sequence encoding the same, targeting the at least one nucleic acid sequence of interest; or providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest;

(c) introducing the at least one base editor complex, or the sequence encoding the same, or the at least one saturated targeted endogenous mutagenesis editor (STEME) complex, or a sequence encoding the same, into the genetic material of the cellular system;

(d) cultivating the cellular system under conditions to obtain a M0 population of the cellular system;

(e) crossing the M0 population of the cellular system with a wildtype population of the cellular system comprising the at least one nucleic acid sequence of interest to obtain a progeny population of the cellular system;

(f) obtaining a progeny population of the cellular system having at least one modification in the at least one nucleic acid sequence of interest;

(g) screening the progeny population of the cellular system for the agronomically important phenotype associated with at the least one modification in the at least one nucleic acid of interest; and (h) identifying and thereby selecting a cellular system from the progeny population having the agronomically important phenotype, (i) obtaining a progeny of a modified cellular system having the agronomically important phenotype, wherein the array of guide RNAs comprises at least two guide RNA molecules, or a sequence encoding the same, targeting the at least one nucleic acid sequence of interest; and wherein the array of guide RNAs of the at least one STEME complex comprises at least one guide RNA molecules, or a sequence encoding the same, targeting the at least one nucleic acid sequence of interest.

Using this strategy of generating a progeny by crossing the M0 population with a wildtype population, large mutant populations can be produced of basically any plant species for screening.

In one embodiment of the various aspects of the present invention described above, the array of guide RNAs of the base editor complex comprises at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, or more individual guide RNA molecules targeting the at least one nucleic acid sequence of interest.

In another embodiment of the various aspects of the present invention described above, the array of guide RNAs of the STEME complex comprises at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, or more individual guide RNA molecules targeting the at least one nucleic acid sequence of interest.

In yet another embodiment of the various aspects of the present invention described above, the guide RNA molecules target overlapping and/or distinct fragments of the nucleic acid sequence of interest.

The number of gRNAs used depends on the size of the target region(s) and the desired mutation density. A single gRNA can cause multiple mutations in the editing window but also two or more gRNAs targeting close-by or overlapping regions can be used. It is likely that many different gRNA arrays may be useful against a single genomic target in order to preferentially obtain different mutagenesis profiles. The design of the array depends on the purpose of the mutagenesis, i.e. whether mutagenesis is desired for the whole ORF of a gene or a certain domain of a protein or regulatory regions of a gene (see example 2).

When the gRNA sequences are designed, multiplex is the preferred method for cloning since for individual cloning, the number of constructs and transformations to be performed and screening of the population can easily result in large efforts and costs. There are several vector systems available for cloning multiplex gRNAs (see example 3).

In one embodiment of the various aspects of the present invention described above, the at least one base editor complex or the at least one STEME complex or a component thereof is introduced as part of at least one plasmid, at least one vector, or at least one linear DNA molecule, as RNA molecule and/or as a preassembled complex of RNA and/or protein.

In another embodiment of the various aspects of the present invention described above, the at least one base editor complex or the at least one STEME complex is introduced into the cellular system by biological or physical means, including transfection, transformation, including transformation by *Agrobacterium* spp., preferably *Agrobacterium tumefaciens*, a viral vector, biolistic bombardment, transfection using chemical reagents, including polyethylene glycol transfection, or any combination thereof.

Any suitable delivery method to introduce the at least one base editor complex or a component thereof, or the at least one STEME complex or a component thereof into a cell or cellular system of interest can be applied, depending on the cell or cellular system of interest. The term "introduction" as used herein thus implies a functional transport of a biomolecule or genetic construct (DNA, RNA, single- or double-stranded, protein, comprising natural and/or synthetic components, or a mixture thereof) into at least one cell or into a compartment of interest, e.g. the nucleus or an organelle, or into the cytoplasm, which allows the transcription and/or translation and/or the catalytic activity and/or binding activity, including the binding of a nucleic acid molecule to another nucleic acid molecule, including DNA or RNA, or the binding of a protein to a target structure within the at least one cell or cellular system, and/or the catalytic activity of an enzyme such introduced, optionally after transcription and/or translation.

Therefore, a variety of delivery techniques may be suitable according to the methods of the present invention for introducing the at least one base editor complex or a component thereof, or the at least one STEME complex or a component thereof into a plant cell or a cellular system derived from a plant cell, the delivery methods being known to the skilled person, e.g., by choosing direct delivery techniques ranging from polyethylene glycol (PEG) treatment of protoplasts, procedures like electroporation, microinjection, silicon carbide fiber whisker technology, viral vector mediated approaches and particle bombardment.

A common biological means is transformation with *Agrobacterium* spp. which has been used for decades for a variety of different plant materials. Viral vector mediated plant transformation represents a further strategy for introducing genetic material into a cell of interest.

Notably, said delivery methods for transformation and transfection can be applied to introduce components of the at least one base editor complex simultaneously. The above delivery techniques, alone or in combination, can be used for in vivo (in planta) or in vitro approaches. According to the various embodiments of the present invention, different delivery techniques may be combined with each other to introduce the at least one base editor complex or components thereof, or the at least one STEME complex or components thereof.

The array of gRNAs can be delivered in one construct or multiple constructs. The gRNAs may be efficiently expressed from commonly used promoters.

In one embodiment of the various aspects of the present invention described above, the at least one nucleic acid sequence of interest is/are (an) endogenous gene(s) or genetic element(s) associated with an agronomically important phenotype.

Modification of endogenous genes, which encode traits related to agricultural performance, is likely to result in an improvement or an optimization of the respective trait(s). On the other hand, modification of genetic elements such as regulatory sequences associated with such traits may also have a large impact on agricultural performance. It may also be desirable to target both, endogenous trait related genes and the associated regulatory sequences, at the same time to identify or generate an agronomically important phenotype.

In one embodiment of the various aspects of the present invention described above, the endogenous gene(s) is/are selected from the group consisting of a gene encoding resistance or tolerance to abiotic stress, including drought stress, osmotic stress, heat stress, cold stress, oxidative stress, heavy metal stress, nitrogen deficiency, phosphate deficiency, salt stress or waterlogging, herbicide resistance, including resistance to glyphosate, glufosinate/phosphinotricin, hygromycin, protoporphyrinogen oxidase (PPO) inhibitors, ALS inhibitors, and Dicamba, a gene encoding resistance or tolerance to biotic stress, including a viral resistance gene, a fungal resistance gene, a bacterial resistance gene, an insect resistance gene, or a gene encoding a yield related trait, including lodging resistance, flowering time, shattering resistance, seed colour, endosperm composition, or nutritional content.

In another embodiment of the various aspects of the present invention described above the genetic element(s) is/are at least part of a regulatory sequence, wherein the regulatory sequence comprises at least one of a core promoter sequence, a proximal promoter sequence, a cis regulatory sequence, a trans regulatory sequence, a locus control sequence, an insulator sequence, a silencer sequence, an enhancer sequence, a terminator sequence, and/or any combination thereof.

One or more modifications induced in a regulatory sequence may result in an altered expression of one or more target gene(s). For example, a modified promoter sequence may show increased promoter activity, increased promoter tissue specificity, decreased promoter activity or decreased promoter tissue specificity compared to the unedited promoter sequence. Furthermore, a new promoter activity, an inducible promoter activity, an extended window of gene expression, a modification of the timing or developmental progress of gene expression in the same cell layer or other cell layer, for example, extending the timing of gene expression in the tapetum of anthers, a mutation of DNA binding elements and/or a deletion or addition of DNA binding elements may result from the modification.

In one embodiment of the various aspects of the present invention described above, the at least one base editor complex induces at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, or even more nucleotide exchange(s) in the nucleic acid sequence of interest.

The methods according to the present invention allow site-specific, density-tuneable mutagenesis at multiple target nucleotides. The modifications may be associated in terms of spatial proximity or genomic context or they may be completely unrelated. An agronomically important phenotype identified or generated with a method according to the present invention may thus exhibit one or more polygenic traits.

In another embodiment of the various aspects of the present invention, the at least one site-specific base editor comprises at least one nucleic acid recognition domain and at least one nucleic acid editing domain, and the at least one STEME comprises at least one nucleic acid recognition domain and at least two nucleic acid editing domains, wherein the at least one nucleic acid recognition domain independently is selected from the disarmed and nickase version of any CRISPR nucleases, including but not limited to CRISPR-dCas9, CRISPR-dCpf1, CRISPR-dCsm1, CRISPR-dCasX, CRISPR-dCasY, CRISPR-dMAD7, CRISPR-Cas9 nickase, CRISPR-Cpf1 nickase, CRISPR-Csm1 nickase, CRISPR-CasX nickase, CRISPR-CasY nickase or CRISPR-MAD7 nickase, and wherein the at least one or at least two nucleic acid editing domain is independently selected from a cytidine deaminase or a adenine deaminase, preferably wherein the at least one nucleic acid editing domain is independently selected from an apolipoprotein B mRNA-editing complex (APOBEC) family deaminase, preferably a rat-derived APOBEC, an activation-induced cytidine deaminase (AID), an ACF1/ASE deaminase, an ADAT family deaminase, an ADAR2 deaminase, or a PmCDA1 deaminase, a TadA derived deaminase, and/or any combination, variant, or catalytically active fragment thereof, and wherein the at least one site-specific base editor optionally comprises at least one nuclear localization signal, and wherein the at least one base editor optionally comprises at least one linker sequence, preferably an XTEN linker, and wherein the at least one base editor optionally comprises at least one component inhibiting naturally occurring DNA or RNA repair, preferably an uracil DNA glycosylase inhibitor (UGI) domain, a Gam protein domain of bacteriophage Mu or an inhibitor of inosine base excision repair domain.

The nucleic acid recognition domain may be based on a CRISPR system, comprising a modified CRISPR nuclease, which directs the base editor to the desired target site but lacks any nuclease function or preferably is modified to act as a nickase (e.g. nCas9). Therefore, the CRISPR nuclease does not introduce double strand breaks, but merely nicks in the non-edited strand. Conversion of the targeted nucleotide (s) is initiated by the action of a cytidine deaminase or an adenine deaminase. A CRISPR nucleic acid recognition domain may be selected from different organisms such as e.g. *S. pyogenes* or *S. aureus.*

Suitable nucleic acid editing domains may comprise apolipoprotein B mRNA-editing complex (APOBEC) family deaminase, preferably a rat-derived APOBEC, an activation-induced cytidine deaminase (AID), an ACF1/ASE deaminase, an ADAT family deaminase, an ADAR2 deaminase, or a PmCDA1 deaminase, a TadA derived deaminase, and/or any combination, variant, or catalytically active fragment thereof. Information on these and further deaminases suitable as base editor component according to the present disclosure can be obtained from WO2015089406A1, WO2017070632A2, WO2017070633A2, WO2018027078A1 or WO2015133554A1.

Information regarding the use of a Gam protein domain of bacteriophage Mu in the context of base editing can be found in Komor et al., "Improved base excision repair inhibition and bacteriophage Mu Gam protein yields C:G-to-T:A base editors with higher efficiency and product purity", Science Advances, 2017, Vol. 3, No. 8: eaao4774.

There are three BE versions described in Komor et al., 2016 (Komor et al., Nature, 2016, 533(7603), 420-424), namely BE1, BE2 and BE3, with BE3 showing the highest efficiency of targeted C to T conversion, resulting in up to 37% of desired C to T conversion in human cells. BE3 is composed of APOBEC-XTEN-dCas9(A840H)-UGI, where APOBEC1 is a cytidine deaminase, XTEN is 16-residue linker, dCas9(A840H) is a nickase version of Cas9 that nicks the non-edited strand and UGI is an Uracil DNA glycosylase inhibitor. In this system, the BE complex is guided to the target DNA by the sgRNA, where the cytosine is then converted to uracil by cytosine deamination. The UGI inhibits the function of cellular uracil DNA glycosylase, which catalyses removal of uracil from DNA and initiates base-excision repair (BER). Nicking of the unedited DNA strand helps to resolved the U:G mismatch into desired U:A and T:A products.

As mentioned above, BEs are efficient in converting C to T (G to A), but are not capable of A to G (T to C) conversion. ABEs were first developed by Gaudelli et al., 2017 (Gaudelli et al., Nature, 2017, 551, 464-471) for converting A-T to G-C. A transfer RNA adenosine deaminase was evolved to operate on DNA, which catalyzes the deamination of adenosine to yield inosine, which is read and replicated as G by polymerases. By fusion of the evolved adenine deaminase and a Cas9 module, ABEs described in Gaudelli et al., 2017 (vide supra) showed about 50% efficiency in targeted A to G conversion.

Zong et al. (Zong et al., Nature Biotechnology, vol. 25, no. 5, 2017, 438-440), adopted the BE2 and BE3 (Komor et al., 2016, vide supra), which are composed of ratAPOBEC1-Cas9 (catalytically dead for BE2 and nickase for BE3)-UGI, codon optimized the sequence for cereal plants, cloned them under the maize Ubiquitin-1 gene promoter and then applied them in rice, wheat and maize. They reported that using CRISPR-Cas9 nickase-cytidine deaminase fusion, the targeted conversion of C to T in both protoplasts and regenerated rice, wheat and maize plants showed frequencies up to 43.48%. Yan et al. and Hua et al. both reported the adoption of ABE described in Gaudelli et al., 2017 (vide supra) to generate targeted A-T to G-C mutations in rice plants (Yan et al., Molecular Plant, vol. 11, 4, 2018, 631-634; Hua et al., Molecular Plant, vol. 11, 4, 2018, 627-630). Codon optimization for expression in rice was performed in Yan et al.; whereas Hua et al. used the mammalian codon-optimized sequences described in Gaudelli et al., in addition with a strong VirD2 nuclear localization signal fusion to the C terminus of the Cas9(D10A) nickase from both *S. pyogenes* and *S. aureus*. Both work demonstrated successful application of ABEs that introduce A to G conversion in rice plants.

Current CRISPR-based base editors have sequence limitations in the PAM site and in the nucleotide bases that can be converted (currently C->T or A->G). Because high genetic diversity induced by this base editor mutagenesis increases the possible genetic space that can be sampled for useful phenotypes, it is in general useful to have base editors with lower PAM requirements (to increase the density of guide RNAs within a region of interest), more flexibility in residue conversions (for theoretical example, C->T, G, or A; A->G, T, or C; G->A, C, or T; and T->C, A, or G), and larger conversion windows.

One of the preferred base editor is a recently developed A3A-PBE, consisting of the human APOBEC3A (A3A) cytidine deaminase fused with a Cas9-nickase (codon-optimized for cereal plants). The advantage of this base editor is that it has a 17-nucleotide editing window and the activity is independent of sequence context. Basically, the A3A base editor is composed of APOBEC3A-XTEN-nCas9-NLS-UGI-NLS under the control of the Ubi1 promoter and CaMV terminator (Zong et al., Nature Biotechnology, 36, 2018, 950-953). The sequence is codon optimized for a cereal plant but may be optimized for other plants by means known to the skilled person. Compared to the original PBE developed based on rat APOBEC1-based BE3, which has a narrow editing window of 4-5 nt and is inefficient in high GC context (Zong et al., Nature Biotechnology, vol. 25, no. 5, 2017, 438-440 and Komor et al., 2016, vide supra) the A3A base editor converts C to T efficiently in wheat, rice and potato with a 17-nt editing window at all examined sites, independent of sequence context.

Base editors with wide conversion windows are more advantageous than those with narrow conversion windows due to their ability to affect more sequence space per guide RNA. For this reason, the recently described BE-PLUS system or similar systems are further preferred in the context of the present invention (Jiang et al., "BE-PLUS: a new base editing tool with broadened editing window and enhanced fidelity", Cell Research, 2018, Vol. 28, Issue 8, 855-861).

Further, the inventors envisioned the possibility where a single protein using a single sgRNA would perform A:T>G:C substitutions in addition to C:G>T:A substitutions and act as a novel saturated targeted endogenous mutagenesis editor (STEME) (FIG. 1a). They therefore combined a cytidine deaminase with an adenosine deaminase to obtain a fusion deaminase. In addition to the fusion deaminase, the STEME may contain for instance nCas9 (D10A) and uracil DNA glycosylase inhibitor (UGI) (FIG. 1a). This novel STEME make use of e.g. the high efficiency cytosine base editor, A3A-PBE, with a wide base editing window in plants and the plant adenine base editor, PABE-7, containing an evolved tRNA adenosine deaminase (ecTadA-ecTadA7.10). To generate both C:G>T:A and A:T>G:C substitutions in the same target sequence using a single protein, the inventors fused for example APOBEC3A-ecTadA65-ecTadA7.10 or ecTadA-ecTadA7.10-APOBEC3A to the N terminus of for instance nCas9 (D10A), together with UGI or two copies of free UGI at the C terminus of nCas9 (D10A), generating STEME-1 (DNA=SEQ ID NO: 175: APOBEC3A (1 . . . 597)-48aa linker (598 . . . 741)-ecTadA (742 . . . 1239)-32aa linker (1240 . . . 1335)-ecTadA7.10 (1336 . . . 1833)-32aa linker (1834 . . . 1929)-nCas9 (D10A) (1930 . . . 6030)-NLS (6031 . . . 6078)-UGI (6097 . . . 6345)-NLS (6358 . . . 6378); protein=SEQ ID NO: 176), STEME-2 (DNA=SEQ ID NO: 177: ecTadA (1 . . . 501)-32aa linker (502 . . . 597)-ecTadA7.10 (598 . . . 1095)-32aa linker (1096 . . . 1191)-APOBEC3A (1192 . . . 1785)-16aa linker (1786 . . . 1833)-nCas9 (D10A) (1840 . . . 5940)-NLS (5941 . . . 5988)-UGI (6007 . . . 6255)-NLS (6268 . . . 6288); protein=SEQ ID NO: 178), STEME-3 (DNA=SEQ ID NO: 179: APOBEC3A (1 . . . 597)-48aa linker (598 . . . 741)-ecTadA (742 . . . 1239)-32aa linker (1240 . . . 1335)-ecTadA7.10 (1195 . . . 1833)-32aa linker (1834 . . . 1929)-nCas9 (D10A) (1930 . . . 6030)-NLS (6031 . . . 6078)-T2A (6085 . . . 6138)-UGI (6139 . . . 6387)-NLS (6400 . . . 6420)-T2A (6421 . . . 6474)-UGI (6475 . . . 6723)-NLS (6736 . . . 6756); protein=SEQ ID NO: 180), and STEME-4 (DNA=SEQ ID NO: 181: ecTadA (1 . . . 501)-32aa linker (502 . . . 597)-ecTadA7.10 (598 . . . 1095)-32aa linker (1096 . . . 1191)-APOBEC3A (1192 . . . 1785)-16aa linker (1786 . . . 1833)-nCas9 (D10A) (1834 . . . 5934)-NLS (5935 . . . 5982)-T2A (5989 . . . 6042)-UGI (6043 . . . 6291)-NLS (6304 . . . 6324)-T2A (6325 . . . 6378)-UGI (6379 . . . 6627)-NLS (6640 . . . 6660); protein=SEQ ID NO: 182). The STEMEs may be codon optimized for crop plants, and driven by a promoter functional in a plant cell, like the Ubi-1 promoter of maize. The C>T base editing windows preferably ranges from 0.10-60%, with STEME-1 the most efficient. Within the primary editing window of A3A-PBE (C1-C17; counting the end distal to the PAM as position 1), STEME-1 shows a C>T editing efficiency averaging 25.14% in different gene targets. The C>T editing efficiency was 1.5-fold higher than A3A-PBE (average 17.25%).

STEME-1 also shows the highest A>G base editing efficiency (0.69-15.50%) amongst the four STEMEs and an A>G base editing window of A4 to A8. STEME-1's A>G editing efficiency was able to provide the desired diversity for an improved directed evolution strategy. Moreover, usually of the instances of A>G substitution by STEME-1, this was accompanied by simultaneous C>T editing in the same DNA strand. No undesired editing at any of desired sgRNA targets is apparent (<0.05%). Indel frequencies with STEMEs were also equivalent to that in untreated control plant cells. STEMEs may induce both C>T and A>G conversions using only one sgRNA and STEME-1 is effective at generating simultaneous mutations to increase the diversity of mutations at a target site.

In order to expand the targeting scope of STEME-1 or another STEME, the nCas9 (D10A) was replaced with codon-optimized nCas9-NG (D10A) to produce STEME-NG (DNA=SEQ ID NO: 183: APOBEC3A (1 . . . 597)-48aa linker (598 . . . 741)-ecTadA (742 . . . 1239)-32aa linker (1240 . . . 1335)-ecTadA7.10 (1336 . . . 1833)-32aa linker (1834 . . . 1929)-nCas9-NG (D10A) (1930 . . . 6030)-NLS (6031 . . . 6078)-UGI (6100 . . . 6360)-NLS (6361 . . . 6381); protein=SEQ ID NO: 184) derived from STEME 1. STEME-NG has a broad capacity for editing C>T and A>G in NG PAM sequences, but preferred NGD (D=A, T or G) PAMs. STEME-NG exhibited compromised activity (average C>T 7.92%, A>G 1.84%) at canonical NGG PAM sequences compared with STEME-1 (average C>T 17.89%, A>G 3.80%). STEME-NG edits cytosines in a window of C1 to C17 and adenines in a window of A4 to A8. In addition, STEME-NG generated indels at much lower frequencies (<0.10%) than pCas9-NG (0.16-13.24%) in plant cells, e.g. protoplasts. Taken together, the editing activities of STEME-NG depends on the nature of the Cas9-NG.

It prefers NGD PAMs to NGC PAMs. Although the editing efficiency of STEME-NG was on average 2.2-fold lower than that of STEME-1 on NGG PAM, the below data suggests that STEME-NG may expand the scope of C>T and A>G base editing and may facilitate the application of directed evolution in plants.

The present invention demonstrates that STEME-aided directed editing is an effective tool for mutagenesis in plants. STEMEs can generate diverse mutations, including base substitutions and in-frame indels, facilitating analysis of protein function and development of agronomic traits. Meanwhile, the high product purity and low indel numbers obtained by editing protoplasts point to the importance of transient expression of CRISPR. The STEME system could be used for directed evolution of e.g. protein-coding genes where a new or alternative functional activity is desired and this system may also be applicable beyond plants, for example, for screening drug resistance mutants, altering cis-elements on noncoding regions and correcting pathogenic SNVs in animals.

In one embodiment of the various aspects of the present invention described above, the at least one base editor component, or the sequence encoding the same, or the at least one STEME component, or the sequence encoding the same, is provided as a fusion molecule.

In another embodiment of the various aspects of the present invention described above, the components of the base editor complex, or the sequences encoding the same, or the at least one STEME component, or the sequence encoding the same, are provided as individual molecules.

The components of the at least one base editor or the at least one STEME can be present as fusion molecules, or as individual molecules associating by or being associated by at least one of a covalent or non-covalent interaction so that the components of the at least one base editor complex are brought into close physical proximity.

A fusion can for example provide for subcellular localization of the base editor (e.g., a nuclear localization signal (NLS) for targeting (e.g., a site-specific nuclease) to the nucleus, a mitochondrial localization signal for targeting to the mitochondria, a chloroplast localization signal for targeting to a chloroplast and the like.

In one embodiment of the various aspects of the present invention described above, the cellular system is selected from a eukaryotic organism, wherein the eukaryotic organism is a plant, part of a plant or a plant cell.

In another embodiment of the various aspects of the present invention described above, the part of the plant is selected from the group consisting of leaves, stems, roots, emerged radicles, flowers, flower parts, petals, fruits, pollen, pollen tubes, anther filaments, ovules, embryo sacs, egg cells, ovaries, zygotes, embryos, zygotic embryos, somatic embryos, apical meristems, vascular bundles, pericycles, seeds, roots, and cuttings. The plant cell can be a protoplast.

In yet another embodiment of the various aspects of the present invention described above, the plant, part of a plant or plant cell is, or originates from, a plant species selected from the group consisting of: *Hordeum vulgare, Hordeum bulbusom, Sorghum bicolor, Saccharum officinarium, Zea mays, Setaria italica, Oryza minuta, Oriza sativa, Oryza australiensis, Oryza alta, Triticum aestivum, Secale cereale, Malus domestica, Brachypodium distach-yon, Hordeum marinum, Aegilops tauschii, Daucus glochidiatus, Beta vulgaris, Daucus pusillus, Daucus muricatus, Daucus carota, Eucalyptus grandis, Nicotiana sylvestris, Nicotiana tomentosiformis, Nicotiana tabacum, Solanum lycopersicum, Solanum tuberosum, Coffea canephora, Vitis vinifera, Erythrante guttata, Genlisea aurea, Cucumis sativus, Morus notabilis, Arabidopsis arenosa, Arabidopsis lyrata, Arabidopsis thaliana, Crucihimalaya himalaica, Crucihimalaya wallichii, Cardamine flexuosa, Lepidium virginicum, Capsella bursa pastoris, Olmarabidopsis pumila, Arabis hirsute, Brassica napus, Brassica oleeracia, Brassica rapa, Raphanus sativus, Brassica juncea, Brassica nigra, Eruca vesicaria* subsp. *sativa, Citrus sinensis, Jatropha curcas, Populus trichocarpa, Medicago truncatula, Cicer yama-shitae, Cicer bijugum, Cicer arietinum, Cicer reticulatum, Cicer judaicum, Cajanus cajanifolius, Cajanus scarabaeoides, Phaseolus vulgaris, Glycine max, Astragalus sinicus, Lotus japonicas, Torenia fournieri, Spinacea oleracea, Phaseolus vulgaris, Vicia faba, Allium cepa, Allium fistulosum, Allium sativum,* and *Allium tuberosum.*

According to a further aspect, the present invention also relates to a modified cellular system obtained by a method of any of the aspects and embodiments described above.

According to yet a further aspect, the present invention also relates to the use of at least one base editor complex or at least one STEME complex comprising an array of guide RNAs targeting at least one nucleic acid sequence of interest in the genetic material of a cellular system for (a) generating a cellular system having an agronomically important phenotype associated with at least one modification in the at least one nucleic acid sequence of interest; and/or (b) identification of an agronomically important phenotype associated with at least one modification in the at least one nucleic acid sequence of interest in the genetic material of the cellular system.

For the use of at least one base editor complex comprising an array of guide RNAs or the use of at least one STEME complex comprising an array of guide RNAs, the details and features described in the context of the various aspects and embodiments above, apply accordingly.

A preferred embodiment is the use of at least one base editor complex or of at least one STEME complex comprising an array of guide RNAs targeting at least one nucleic acid sequence in the genetic material of a cellular system in a method of identifying an agronomically important phenotype in a cellular system as defined in any of the aspects and embodiments above.

Another preferred embodiment is the use of at least one base editor complex or of at least one STEME complex comprising an array of guide RNAs targeting at least one nucleic acid sequence in the genetic material of a cellular system in a method of generating a modified cellular system having an agronomically important phenotype or in a method of generating a progeny of a modified cellular system having an agronomically important phenotype as defined in any of the aspects and embodiments above.

In one embodiment of the use according to the invention related to at least one base editor complex, the array of guide RNAs comprises at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, or more individual guide RNA molecules targeting the at least one nucleic acid sequence of interest and the use according to the invention related to at least one STEME complex, the array of guide RNAs comprises at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, or more individual guide RNA molecules targeting the at least one nucleic acid sequence of interest.

In another embodiment of the use according to the invention, the guide RNA molecules target overlapping and/or distinct fragments of the nucleic acid sequence of interest.

In a further embodiment of the use according to the invention, the at least one base editor complex or a component thereof or the at least one STEME complex or a component thereof is introduced as part of at least one plasmid, at least one vector, or at least one linear DNA molecule, as RNA molecule and/or as a preassembled complex of RNA and/or protein.

In one embodiment of the use according to the invention, the at least one base editor complex or the at least one STEME complex is introduced into the cellular system by biological or physical means, including transfection, transformation, including transformation by *Agrobacterium* spp., preferably *Agrobacterium tumefaciens*, a viral vector, biolistic bombardment, transfection using chemical reagents, including polyethylene glycol transfection, or any combination thereof.

In another embodiment of the use according to the invention, the at least one nucleic acid sequence of interest is/are (an) endogenous gene(s) or genetic element(s) associated with an agronomically important phenotype.

In a further embodiment of the use according to the invention, the endogenous gene(s) described above is/are selected from the group consisting of a gene encoding resistance or tolerance to abiotic stress, including drought stress, osmotic stress, heat stress, cold stress, oxidative stress, heavy metal stress, nitrogen deficiency, phosphate deficiency, salt stress or waterlogging, herbicide resistance, including resistance to glyphosate, glufosinate/phosphinotricin, hygromycin, protoporphyrinogen oxidase (PPO) inhibitors, ALS inhibitors, and Dicamba, a gene encoding resistance or tolerance to biotic stress, including a viral resistance gene, a fungal resistance gene, a bacterial resistance gene, an insect resistance gene, or a gene encoding a yield related trait, including lodging resistance, flowering time, shattering resistance, seed colour, endosperm composition, or nutritional content.

In yet a further embodiment of the use according to the invention, the genetic element described above is at least part of a regulatory sequence, wherein the regulatory sequence comprises at least one of a core promoter sequence, a proximal promoter sequence, a cis regulatory sequence, a trans regulatory sequence, a locus control sequence, an insulator sequence, a silencer sequence, an enhancer sequence, a terminator sequence, and/or any combination thereof.

In one embodiment of the use according to the invention, the at least one base editor complex induces at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, or even more nucleotide exchange(s) in the nucleic acid sequence of interest.

In another embodiment of the use according to the invention, the at least one base editor component of the at least one base editor complex comprises at least one nucleic acid recognition domain and at least one nucleic acid editing domain and the at least one STEME comprises at least one nucleic acid recognition domain and at least two nucleic acid editing domains, wherein the at least one nucleic acid recognition domain is independently selected from the disarmed and nickase version of any CRISPR nucleases, including but not limited to CRISPR-dCas9, CRISPR-dCpf1, CRISPR-dCsm1, CRISPR-dCasX, CRISPR-dCasY, CRISPR-dMAD7, CRISPR-Cas9 nickase, CRISPR-Cpf1 nickase, CRISPR-Csm1 nickase, CRISPR-CasX nickase, CRISPR-CasY nickase or CRISPR-MAD7 nickase, and wherein the at least one nucleic acid editing domain or the at least two nucleic acid editing domain is independently selected from a cytidine deaminase or a adenine deaminase, preferably wherein the at least one nucleic acid editing domain is independently selected from an apolipoprotein B mRNA-editing complex (APOBEC) family deaminase, preferably a rat-derived APOBEC, an activation-induced cytidine deaminase (AID), an ACF1/ASE deaminase, an ADAT family deaminase, an ADAR2 deaminase, or a PmCDA1 deaminase, a TadA derived deaminase, and/or any combination, variant, or catalytically active fragment thereof, and wherein the at least one site-specific base editor optionally comprises at least one nuclear localization signal, and wherein the at least one base editor optionally comprises at least one linker sequence, preferably an XTEN linker, and wherein the at least one base editor optionally comprises at least one component inhibiting naturally occurring DNA or RNA repair, preferably an uracil DNA glycosylase inhibitor (UGI) domain, a Gam protein domain of bacteriophage Mu, or an inhibitor of inosine base excision repair domain.

In a further embodiment of the use according to the invention, the at least one base editor component, or the sequence encoding the same, or the at least one STEME component, or the sequence encoding the same, is provided as a fusion molecule.

In yet a further embodiment of the use according to the invention, the components of the base editor complex, or the sequences encoding the same, or the components of the STEME complex, or the sequences encoding the same, are provided as individual molecules.

In one embodiment of the use according to the invention, the cellular system is selected from a eukaryotic organism, wherein the eukaryotic organism is a plant, part of a plant or a plant cell.

In another embodiment of the use according to the invention, the part of the plant described above is selected from the group consisting of leaves, stems, roots, emerged radicles, flowers, flower parts, petals, fruits, pollen, pollen tubes, anther filaments, ovules, embryo sacs, egg cells, ovaries, zygotes, embryos, zygotic embryos, somatic embryos, apical meristems, vascular bundles, pericycles, seeds, roots, and cuttings.

In a further embodiment of the use according to the invention, the plant, part of a plant or plant cell described above is, or originates from, a plant species selected from the group consisting of: *Hordeum vulgare, Hordeum bulbusom, Sorghum bicolor, Saccharum officinarium, Zea mays, Setaria italica, Oryza minuta, Oriza sativa, Oryza australiensis, Oryza alta, Triticum aestivum, Secale cereale, Malus domestica, Brachypodium distach-yon, Hordeum marinum, Aegilops tauschii, Daucus glochidiatus, Beta vulgaris, Daucus pusillus, Daucus muricatus, Daucus carota, Eucalyptus grandis, Nicotiana sylvestris, Nicotiana tomentosiformis, Nicotiana tabacum, Solanum lycopersicum, Solanum tuberosum, Coffea canephora, Vitis vinifera, Erythrante guttata, Genlisea aurea, Cucumis sativus, Morus notabilis, Arabidopsis arenosa, Arabidopsis lyrata, Arabidopsis thaliana, Crucihimalaya himalaica, Crucihimalaya wallichii, Cardamine flexuosa, Lepidium virginicum, Capsella bursa pastoris, Olmarabidopsis pumila, Arabis hirsute, Brassica napus, Brassica oeleracia, Brassica rapa, Raphanus sativus, Brassica juncea, Brassica nigra, Eruca vesicaria* subsp. *sativa, Citrus sinensis, Jatropha curcas, Populus trichocarpa, Medicago truncatula, Cicer yama-shitae, Cicer bijugum, Cicer arietinum, Cicer reticulatum, Cicer judaicum, Cajanus cajanifolius, Cajanus scarabaeoides, Phaseolus vulgaris, Glycine max, Astragalus sinicus, Lotus japonicas, Torenia fournieri, Spinacea oleracea, Phaseolus vulgaris, Vicia faba, Allium cepa, Allium fistulosum, Allium sativum,* and *Allium tuberosum.*

According to yet a further aspect, the present invention also relates to a modified cellular system obtained by a method described above.

According to yet a further aspect, the present invention also relates to a nucleic acid molecule encoding a saturated targeted endogenous mutagenesis editor (STEME). Preferably, the nucleic acid molecule comprises a nucleotide sequence according to SEQ ID NO: 175, SEQ ID NO: 177, SEQ ID NO: 179, SEQ ID NO: 181, or SEQ ID NO 183; or a nucleotide sequence having an identity of at least 80%, at least 85%, at least 90%, at least 92%, at least 94%, at least 95%, at least 96%, at least 97%, at least 98%, or at least 99% with SEQ ID NO: 175, SEQ ID NO: 177, SEQ ID NO: 179, SEQ ID NO: 181, or SEQ ID NO 183, or a nucleotide sequence encoding a deaminase fusion protein according to SEQ ID NO: 176, SEQ ID NO: 178, SEQ ID NO: 180, SEQ ID NO: 182, or SEQ ID NO 184; or a nucleotide sequence encoding a deaminase fusion protein having an amino acid sequence with an identity of at least 80%, at least 85%, at least 90%, at least 92%, at least 94%, at least 95%, at least 96%, at least 97%, at least 98%, or at least 99% with SEQ ID NO: 176, SEQ ID NO: 178, SEQ ID NO: 180, SEQ ID NO: 182, or SEQ ID NO 184.

According to yet a further aspect, the present invention also relates to a polypeptide encoding a saturated targeted endogenous mutagenesis editor (STEME). Preferably, the polypeptide encodes a deaminase fusion protein according to SEQ ID NO: 176, SEQ ID NO: 178, SEQ ID NO: 180, SEQ ID NO: 182, or SEQ ID NO 184; or a deaminase fusion protein having an amino acid sequence with an identity of at least 80%, at least 85%, at least 90%, at least 92%, at least 94%, at least 95%, at least 96%, at least 97%, at least 98%, or at least 99% with SEQ ID NO: 176, SEQ ID NO: 178, SEQ ID NO: 180, SEQ ID NO: 182, or SEQ ID NO 184.

Such nucleic acid molecule or encoded polypeptides can be used as STEME or as STEME component in the at least one STEME complex according to any method and use described above.

EXAMPLES

Example 1: Base Editors Used in this Invention

There are several base editors that are available for application in plant, conferring either C to T conversion or A to G conversion in the genomic DNA. One of the preferred base editor is the recently developed A3A-PBE, consisting of the human APOBEC3A (A3A) cytidine deaminase fused with a Cas9-nickase (codon-optimized for cereal plants) described above (Zong et al., 2018, vide supra). The advantage of this base editor is that it has a 17-nucleotide editing window and the activity is independent of sequence context. Any other available base editors can also be used. For example, the Cas9 domain can be swapped with any other CRISPR domain, including but not limited to Cpf1, xCas9, C2c1, CasX, CasY, etc; the cytidine deaminase domain could be one of the following but not limited to rat APOBEC1, PmCDA1, AID. It can also be two component base editors, such as the SunTag-based BE-PLUS base editing system (Jiang et al., "BE-PLUS: a new base editing tool with broadened editing window and enhanced fidelity", Cell Research, 2018, Vol. 28, Issue 8, 855-861). The cytidine deaminase domain of the base editor can be replaced by adenine deaminase which would confer A to G conversions, for example the TadA* domain evolved and optimized from ecTadA.

Example 2: Guide RNA Design for Targeted Mutagenesis

The gene target and specific feature of the gene to be mutagenized depends upon what type of genetic diversity is expected to produce the phenotypes of interest. The flexibility of combining the base editor with guide RNAs make it possible to target any region in the genome. However, a preferred design would be 1) to target sequences encoding the active site of a plant gene (if such information is available); 2) to target the whole coding sequence (if the gene function is known to be related to valuable trait, but detailed structural or functional site information is unknown) or 3) to target the gene regulatory elements such as promoters, terminators, suppressors, and enhancers in order to fine tune the expression pattern of the gene of interest (FIG. 1).

The editing window of the base editor chosen is directly linked with the number of gRNAs needed to achieve certain mutation density. When targeting a coding sequence of a gene, only the gRNAs that cause missense mutations are used, the ones that generate only nonsense or synonymous mutations and the ones that cause splicing changes are excluded. Potential of off-target effects are also considered, therefore only gRNAs with little or no potential off-targets are included if possible.

Example 3: Cloning Strategy for Mutagenesis and Population Screening

Guide RNAs can be cloned individually, but preferably with multiplex.

For individual cloning, the following method is used. APOBEC1, partial nCas9 and UGI sequences (SEQ ID NO: 129) without BsaI were synthesized commercially (GenScript, Nanjing, China) and cloned into the pUC57 (SEQ ID NO: 130) as intermediate vector. Other part of nCas9 (SEQ ID NO: 131) was excised from pHUE411 (Xing, Hui-Li, et al. 2014. 'A CRISPR/Cas9 toolkit for multiplex genome editing in plants', BMC Plant Biology, 14: 327.) with SdaI and MluI, and ligated to intermediate vector digested with the same two enzymes, yielding the plasmid pUC57-APOBEC1-nCas9-UGI (SEQ ID NO: 132). The full length APOBEC1-nCas9-UGI was excised using XmaJI and SacI, then was subcloned into pHUE411 that had been digested using the same two enzymes. The resultant vector pZRH-PBE (SEQ ID NO: 133) was used to construct sgRNA expression plasmids using restriction enzyme site BsaI.

For multiplex, the cloning of the base editor part can be the same, but the multiple guide RNAs were cloned in a single construct. For example, in CRISPR/Cas9 system, such constructs can be obtained from Golden gate assembly or Gibson (Xing et al. 2014; Rodríguez-Leal et al. 2017, vide supra); or using tRNA-based multiplex CRISPR/Cas9 vector (Xie, Kabin, et al. 2015. 'Boosting CRISPR/Cas9 multiplex editing capability with the endogenous tRNA-processing system', Proceedings of the National Academy of Sciences, 112: 3570-75.; Čermák, Tomáš, et al. 2017. 'A Multipurpose Toolkit to Enable Advanced Genome Engineering in Plants', The Plant Cell, 29: 1196-217.); in CRISPR/Cpf1 system, this can be achieved simply by using a single customized CRISPR array because of the ability of Cpf1 to process its own crRNA (Zetsche, Bernd, et al. 2016. 'Multiplex gene editing by CRISPR-Cpf1 using a single crRNA array', Nature Biotechnology, 35: 31); U.S. 62/616, 136). The number of guide RNAs to be delivered can be further increased by mixing Agrobacterium cultures harboring different guide RNA arrays when using Agrobacterium-mediated transformation or simply by adding more plasmids harboring different guide RNA arrays in the DNA mix when using biolistic delivery.

There are a couple of strategies in which mutagenized populations can be generated for screening. In plants, one strategy (screening strategy I) would be to deliver a single or multiple DNA molecules harboring expression cassettes for the base editor and the guide RNAs to cells or tissue, and then apply a regeneration process that would produce hundreds or thousands of unique M0 plants. This population of M0 plants, or their progeny, would be screened for phenotype (see example 4). An alternative and preferred strategy (screening strategy II) is to use multiplex gRNAs to generate a small number of M0 plants harboring the complete set of base editor and guide RNA expression cassettes, outcross these transgenic plants to a wildtype population to produce a larger population through editing on the wildtype copy of the gene from the cross (Rodríguez-Leal, Daniel, et al. 2017. 'Engineering Quantitative Trait Variation for Crop Improvement by Genome Editing', Cell, 171: 470-80.e8.).

Figure 3B:
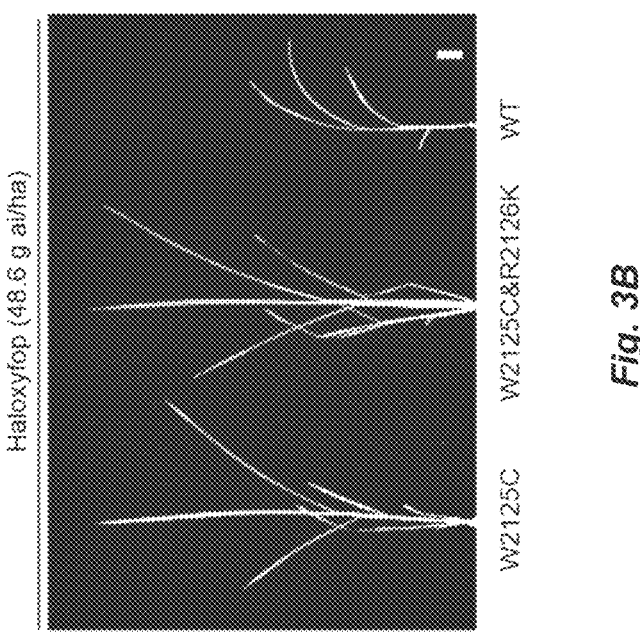
FIG. 3: Generation of novel HR mutations on OsACCase gene by de novo mutagenesis using base editor as described in example 4. (A) Frequencies of nucleotide substitution of 40 sgRNA sites targeting functional domain of OsACCase gene in M0 generation. Position 2125 where W2125C substitution occurred, is marked with an arrow. sgRNAs that coincide with amino acid regions are shown at the top. (B) Phenotypes of T1 edited rice at the OsACCase-W2125 site after haloxyfop treatment. Mutants bearing OsACCase-W2125C and OsACCase-W2125C&R2126K and wild type were treated with haloxyfop (48.6 g a.i./ha) at the four-leaf stage and pictures were taken 10 days later. The scale bar represents 2 cm.
Figure 3A:
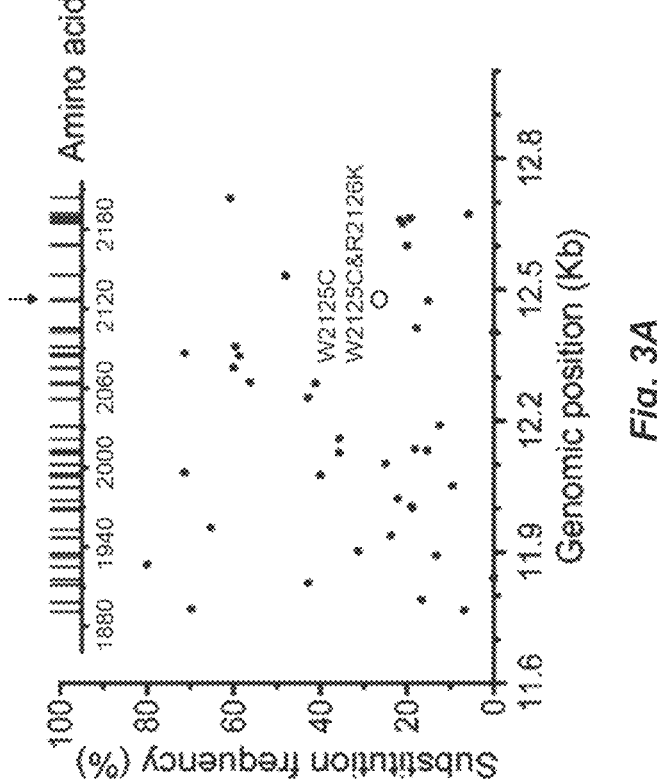

Example 4: De Novo Mutagenesis in the Functional Domain of the Rice Acetyl-CoA Carboxylase (ACCase) Gene ACCase is a key enzyme in plant lipid biosynthesis, which carboxylates acetyl-CoA to form malonyl-CoA, and mutations at A1992 are reported to confer resistance to quizalofop (Ostlie, Michael, et al. 2015. 'Development and characterization of mutant winter wheat (Triticum aestivum L.) accessions resistant to the herbicide quizalofop', Theoretical and Applied Genetics, 128: 343-51.). To generate de novo diverse mutants resistant to herbicides that inhibit ACCase in rice, 40 sgRNAs targeting the functional domain of the ACCase gene are designed (Délye, Christophe, et al. 2005. 'Molecular Bases for Sensitivity to Acetyl-Coenzyme A Carboxylase Inhibitors in Black-Grass', Plant Physiology, 137: 794-806). Individual sgRNAs were cloned into pZRH-PBE vector and the resultant constructs (SEQ ID NO: 134-171) were transformed separately into rice calli (var. Zhonghua11). Target sequences for the 40 sgRNAs are listed in Table 2 below (SEQ ID NO: 1, 8, 11, 15, 22, 27, 32, 40, 42, 47, 49, 53, 59, 61, 64, 68, 71, 73, 76, 79, 81, 83, 85, 88, 90, 92, 94, 99, 102, 104, 107, 109, 113, 115, 119, 122, 125, and 127)nC. Base editor guided by 38/40 sgRNAs performed edits in transgenic M0 plants with a frequency of 5.9-80.0% (FIG. 3A and Table 1), resulting in 86 unique missense edits (Table 2). Herbicide resistance assays of M1 plants, using the ACCase inhibitors, haloxyfop, sethoxydim or pinoxaden, which belong to three distinct chemical groups, revealed that both W2125C and the double mutation W2125C and R2126K conferred resistance to haloxyfop at the field recommended rate 48.6 g a.i./ha (FIG. 3B). W2125C corresponded to W2027C, a natural occurring HR mutation in other three grasses and W2125C and R2126K were not previously reported (Powles, Stephen B., et al. 2010. 'Evolution in Action: Plants Resistant to Herbicides', Annual Review of Plant Biology, 61: 317-47). These results indicated that base-editing mediated de novo mutagenesis was an effective tool to generate novel gain-of-function mutations in plants. Interestingly, W2125C was caused by a G to C transversion at the 11th position of the spacer sequence rather than a G to A transition, which would create a stop codon.

TABLE 1

Frequencies (%) of nucleotide substitution and indel of 40 sites targeting OsACCase.

| Target ID | No. of sequenced plants | No. of WT | No. of indel | Frequency of indel (%) | No. of substi-tution | Frequency of substi-tution (%) |
|---|---|---|---|---|---|---|
| R1 | 53 | 13 | 3 | 5.7 | 37 | 69.8 |
| R2 | 25 | 5 | 0 | 0 | 20 | 80 |
| R3 | 23 | 19 | 1 | 4.8 | 0 | 0 |
| R4 | 32 | 24 | 2 | 3.1 | 6 | 31.3 |
| R5 | 52 | 18 | 0 | 0.0 | 34 | 65.4 |
| R6 | 21 | 14 | 3 | 14.3 | 4 | 19 |
| R7 | 17 | 6 | 1 | 5.9 | 10 | 58.8 |
| R8 | 57 | 17 | 6 | 10.5 | 34 | 59.6 |

TABLE 1-continued

Frequencies (%) of nucleotide substitution and indel of 40 sites targeting OsACCase.

| Target ID | No. of sequenced plants | No. of WT | No. of indel | Frequency of indel (%) | No. of substi-tution | Frequency of substi-tution (%) |
|---|---|---|---|---|---|---|
| R9 | 25 | 25 | 0 | 0 | 0 | 0 |
| R10 | 28 | 23 | 0 | 0 | 5 | 17.9 |
| R11 | 19 | 14 | 0 | 0 | 5 | 26.3 |
| R12 | 27 | 14 | 0 | 0 | 13 | 48.1 |
| R13 | 25 | 20 | 0 | 0 | 5 | 20 |
| R14 | 36 | 27 | 2 | 5.6 | 7 | 19.4 |
| R15 | 23 | 18 | 0 | 0 | 5 | 21.7 |
| R16 | 33 | 28 | 0 | 0 | 5 | 15.2 |
| R17 | 42 | 22 | 2 | 4.8 | 18 | 42.9 |
| R18 | 23 | 6 | 3 | 13.0 | 14 | 60.9 |
| R19 | 29 | 27 | 0 | 0.0 | 2 | 6.9 |
| R20 | 12 | 11 | 0 | 0.0 | 2 | 16.7 |
| R21 | 21 | 14 | 2 | 9.5 | 5 | 23.8 |
| R22 | 16 | 13 | 0 | 0.0 | 3 | 18.8 |
| R23 | 27 | 21 | 0 | 0.0 | 6 | 22.2 |
| R24 | 21 | 16 | 3 | 14.3 | 2 | 9.5 |
| R25 | 5 | 3 | 0 | 0.0 | 2 | 40.0 |
| R26 | 7 | 2 | 0 | 0.0 | 5 | 71.4 |
| R27 | 13 | 11 | 0 | 0.0 | 2 | 15.4 |
| R28 | 7 | 3 | 1 | 14.3 | 3 | 42.9 |
| R29 | 25 | 7 | 3 | 12.0 | 15 | 60.0 |
| R30 | 16 | 5 | 2 | 12.5 | 9 | 56.3 |
| R31 | 17 | 16 | 0 | 0.0 | 1 | 5.9 |
| R32 | 19 | 13 | 2 | 10.5 | 4 | 21.1 |
| R33 | 17 | 9 | 1 | 5.9 | 7 | 41.2 |
| R34 | 14 | 4 | 0 | 0.0 | 10 | 71.4 |
| R35 | 8 | 7 | 0 | 0.0 | 1 | 12.5 |
| R36 | 14 | 9 | 0 | 0.0 | 5 | 35.7 |
| R37 | 11 | 4 | 5 | 45.5 | 2 | 18.2 |
| R38 | 14 | 5 | 4 | 28.6 | 5 | 35.7 |
| R39 | 4 | 1 | 2 | 50.0 | 1 | 25.0 |
| R40 | 15 | 12 | 1 | 6.7 | 2 | 13.3 |

TABLE 2

Analysis of nucleotide and amino acid substitutions targeted 38 sites targeting OsACCase. Nucleotide substitution out of spacer sequence and mosaic mutations were not included in this table. The targeted cytosines or guanines are in italic and the nucleotides substituted by the PBE are in bold.

| Target site | Target site sequences | | Types of amino acid substitution | No. of alleles |
|---|---|---|---|---|
| R1 | CCAGTGCTTATTCTA*GGG*CATAT | (SEQ ID NO: 1) | | 8 |
| | CCAGTGCTTATTCTAGaGCATAT | (SEQ ID NO: 2) | Silent | 16 |
| | CCAGTGCTTATTCTAGcGCATAT | (SEQ ID NO: 3) | R1891S | 1 |
| | CCAGTGCTTATTCTAcaGCATAT | (SEQ ID NO: 4) | R1891T | 1 |
| | CCAGTGCTTATTCTAaaGCATAT | (SEQ ID NO: 5) | R1891K | 12 |
| | CCAGTGCTTATTCTAGaaCATAT | (SEQ ID NO: 6) | A1892T | 10 |
| | CCAGTGCTTATTCTAaaaCATAT | (SEQ ID NO: 7) | R1891K and A1892T | 10 |
| R2 | CCGGTGCATACAGCGTCTT*G*ACC | (SEQ ID NO: 8) | | 6 |
| | CCGGTGCATACAGCGTCTTaACC | (SEQ ID NO: 9) | D1925N | 30 |
| | CCGGTGCATACAGCGTCTTcACC | (SEQ ID NO: 10) | D1925H | 4 |

TABLE 2-continued

Analysis of nucleotide and amino acid substitutions targeted 38 sites targeting OsACCase.
Nucleotide substitution out of spacer sequence and mosaic mutations were not included
in this table. The targeted cytosines or
quanines are in italic and the nucleotides substituted by the PBE are in bold.

| Target site | Target site sequences | | Types of amino acid substitution | No. of alleles |
|---|---|---|---|---|
| R4 | TCTGCACTGAACAAGCTTCTTGG | (SEQ ID NO: 11) | | 6 |
| | TCTGtACTGAACAAGCTTCTTGG | (SEQ ID NO: 12) | A1935V | 3 |
| | TCTGCAtTGAACAAGCTTCTTGG | (SEQ ID NO: 13) | Silent | 2 |
| | TtTGCACTGAACAAGCTTCTTGG | (SEQ ID NO: 14) | S1934F | 1 |
| R5 | CCACATGCAGTTGGGTGGTCCCA | (SEQ ID NO: 15) | | 12 |
| | CCACATGCAGTTGGGTaaTCCCA | (SEQ ID NO: 16) | G1953N | 19 |
| | CCACATGCAGTTGGGTGaTCCCA | (SEQ ID NO: 17) | G1953D | 4 |
| | CCACATGCAGTTGGGTagTCCCA | (SEQ ID NO: 18) | G1953S | 3 |
| | CCACATGCAGTTGGGTGcTCCCA | (SEQ ID NO: 19) | G1953A | 2 |
| | CCACATGCAGTTGGGTcaTCCCA | (SEQ ID NO: 20) | G1953H | 2 |
| | CCACATGCAGTTGGGTACTCCCA | (SEQ ID NO: 21) | G1953T | 2 |
| R6 | CCATCTTACTGTTTCAGATGACC | (SEQ ID NO: 22) | | 2 |
| | CCATCTTACTGTTTCAaATGACC | (SEQ ID NO: 23) | D1969N | 2 |
| | CCATCTTACTGTTTCAcATGACC | (SEQ ID NO: 24) | D1969H | 1 |
| | CCATCTTACTGTTTCAaATaACC | (SEQ ID NO: 25) | D1969N and D1970N | 6 |
| | CCATCTTACTGTTTCAcATaACC | (SEQ ID NO: 26) | D1969H and D1970N | 3 |
| R7 | CCCTGCTGACCCTGGTCAGCTTG | (SEQ ID NO: 27) | | 4 |
| | CCCTGCTGACCCTGGTCAGCTTa | (SEQ ID NO: 28) | D2084N | 1 |
| | CCCTGCTGACCCTGGTCAGCTTc | (SEQ ID NO: 29) | 4H | 1 |
| | CCCTGCTGACCCTGaTCAGCTTG | (SEQ ID NO: 30) | D2081D | 1 |
| | CCCTGCTaACCCTGaTCAaCTTG | (SEQ ID NO: 31) | D2079N, G2081D | 1 |
| R8 | TTCCTCGTGCTGGACAAGTGTGG | (SEQ ID NO: 32) | | 9 |
| | TTtCTCGTGCTGGACAAGTGTGG | (SEQ ID NO: 33) | P2091S | 2 |
| | TTttTCGTGCTGGACAAGTGTGG | (SEQ ID NO: 34) | P2091F | 4 |
| | TTttTtGTGCTGGACAAGTGTGG | (SEQ ID NO: 35) | P2091F, R2092C | 30 |
| | TTCtTtGTGCTGGACAAGTGTGG | (SEQ ID NO: 36) | P2091L, R2092C | 4 |
| | TTCCTtGTGCTGGACAAGTGTGG | (SEQ ID NO: 37) | R2092C | 6 |
| | TTgtTCGTGCTGGACAAGTGTGG | (SEQ ID NO: 38) | R2092V | 2 |
| | TTtgTtGTGCTGGACAAGTGTGG | (SEQ ID NO: 39) | P2091C, R2092C | 1 |
| R10 | CAAGACTGCGCAGGCATTGCTGG | (SEQ ID NO: 40) | | 5 |
| | CAAGAtTGCGCAGGCATTGCTGG | (SEQ ID NO: 41) | T2105I | 5 |
| R11 | CCTCGCTAACTGGAGAGGCTTCT | (SEQ ID NO: 42) | R2126K | 3 |
| | CCTCGCTAACTGaAGAGGCTTCT | (SEQ ID NO: 43) | W2125STOP | 3 |
| | CCTCGCTAACTGcAGAGGCTTCT | (SEQ ID NO: 44) | W2125C | 2 |
| | CCTCGCTAACTGcAaAGGCTTCT | (SEQ ID NO: 45) | W2125C, R2126K | 1 |
| | CCTCGCTAACTGcAGAaaCTTCT | (SEQ ID NO: 46) | W2125C, G2127N | 1 |
| R12 | CGACTATTGTTGAGAACCTTAGG | (SEQ ID NO: 47) | | 11 |
| | CGAtTATTGTTGAGAACCTTAGG | (SEQ ID NO: 48) | T2145I | 11 |

TABLE 2-continued

Analysis of nucleotide and amino acid substitutions targeted 38 sites targeting OsACCase.
Nucleotide substitution out of spacer sequence and mosaic mutations were not included
in this table. The targeted cytosines or
quanines are in italic and the nucleotides substituted by the PBE are in bold.

| Target site | Target site sequences | | Types of amino acid substitution | No. of alleles |
|---|---|---|---|---|
| R13 | CCATGGCTGCAGAGCTACGAGGA | (SEQ ID NO: 49) | | 3 |
| | CCATGGCTGCAGAGCTACaAGGA | (SEQ ID NO: 50) | R2168Q | 2 |
| | CCATGGCTGCAGAGCTACaAGaA | (SEQ ID NO: 51) | R2168Q, G2169R | 1 |
| | CCATGGCTGCaaAGCTACaAGGA | (SEQ ID NO: 52) | E2166K | 2 |
| R14 | CCGCATTGAGTGCTATGCTGAGA | (SEQ ID NO: 53) | | 2 |
| | CCGCATTGAGTGCTATGCTGAaA | (SEQ ID NO: 54) | Silent | 2 |
| | CCGCATTGAGTGCTATGCTaAGA | (SEQ ID NO: 55) | E2189K | 3 |
| | CCGCATTGAGTGCTATGCTaAaA | (SEQ ID NO: 56) | E2189K | 1 |
| | CCGCATTGAGTGCTATGCTcAaA | (SEQ ID NO: 57) | E2189Q | 2 |
| | CCGCATTGAGTGCTATGCTaAcA | (SEQ ID NO: 58) | E2189N | 2 |
| R15 | TATGCTGAGAGGACTGCAAAAGG | (SEQ ID NO: 59) | | 5 |
| | TATGtTGAGAGGACTGCAAAAGG | (SEQ ID NO: 60) | A2188V | 5 |
| R16 | CCAGGATTGCATGAGTCGGCTTG | (SEQ ID NO: 61) | | 2 |
| | CCAGGATTGCATaAGTCGGCTTG | (SEQ ID NO: 62) | M2126I | 3 |
| | CCAGGATTGCATGAGTCaGCTTG | (SEQ ID NO: 63) | M2126I | 1 |
| R17 | GGAGCTTATCTTGCTCGACTTGG | (SEQ ID NO: 64) | | 16 |
| | GGAGtTTATCTTGCTCGACTTGG | (SEQ ID NO: 65) | A1911V | 5 |
| | GGAGCTTATtTTGCTCGACTTGG | (SEQ ID NO: 66) | L1913F | 14 |
| | GGAGCTTATgTTGCTCGACTTGG | (SEQ ID NO: 67) | L1913V | 1 |
| R18 | CCGCAAGGGTTAATTGAGATCAA | (SEQ ID NO: 68) | | 7 |
| | CCGCAAGGGTTAATTGAaATCAA | (SEQ ID NO: 69) | silent | 3 |
| | CCGCAAGGGTTAATTaAaATCAA | (SEQ ID NO: 70) | E2204K | 15 |
| R19 | TGCTTATTCTAGGGCATATAAGG | (SEQ ID NO: 71) | | 1 |
| | TGCTTATTtTAGGGCATATAAGG | (SEQ ID NO: 72) | S1890F | 1 |
| R20 | TTTACACTTACATTTGTGACTGG | (SEQ ID NO: 73) | | 2 |
| | TTTAtACTTACATTTGTGACTGG | (SEQ ID NO: 74) | T1898I | 1 |
| | TTTACAtTTACATTTGTGACTGG | (SEQ ID NO: 75) | L1899F | 1 |
| R21 | AGCTCCCACATGCAGTTGGGTGG | (SEQ ID NO: 76) | | 4 |
| | AGCTttCACATGCAGTTGGGTGG | (SEQ ID NO: 77) | S1947F | 2 |
| | AGCTtttACATGCAGTTGGGTGG | (SEQ ID NO: 78) | S1947F and H1948Y | 4 |
| R22 | ACTGTTTCAGATGACCTTGAAGG | (SEQ ID NO: 79) | | 2 |
| | ACTGTTTtAGATGACCTTGAAGG | (SEQ ID NO: 80) | S1968L | 4 |
| R23 | GCGTTTCTAATATATTGAGGTGG | (SEQ ID NO: 81) | | 3 |
| | GCGTTTtTAATATATTGAGGTGG | (SEQ ID NO: 82) | S1975F | 9 |
| R24 | TATGTTCCTGCCTACATTGGTGG | (SEQ ID NO: 83) | | 2 |
| | TATGTTCtTGCCTACATTGGTGG | (SEQ ID NO: 84) | P1985L | 2 |

TABLE 2-continued

Analysis of nucleotide and amino acid substitutions targeted 38 sites targeting OsACCase.
Nucleotide substitution out of spacer sequence and mosaic mutations were not included
in this table. The targeted cytosines or
quanines are in italic and the nucleotides substituted by the PBE are in bold.

| Target site | Target site sequences | | Types of amino acid substitution | No. of alleles |
|---|---|---|---|---|
| R25 | ACTT*CC*AGTAACAACACCGTTGG | (SEQ ID NO: 85) | | 1 |
| | ACTTCtAGTAACAACACCGTTGG | (SEQ ID NO: 86) | P1193A | 2 |
| | ACTTttAGTAACAACACCGTTGG | (SEQ ID NO: 87) | P1933L | 1 |
| R26 | AA*C*AACACCGTTGGACCCACCGG | (SEQ ID NO: 88) | | 4 |
| | AACAAtACCGTTGGACCCACCGG | (SEQ ID NO: 89) | T1995N | 4 |
| R27 | GAA*C*TCGTGTGATCCTCGAG*C*GG | (SEQ ID NO: 90) | | 1 |
| | GAACTtGTGTGATCCTCGAGCGG | (SEQ ID NO: 91) | S2012L | 3 |
| R28 | GTTA*C*TGGCAGAGCAAAGCTTGG | (SEQ ID NO: 92) | | 0 |
| | GTTAtTGGCAGAGCAAAGCTTGG | (SEQ ID NO: 93) | T2052I | 6 |
| R29 | CAAA*C*TAT*C*CCTGCTGACCCTGG | (SEQ ID NO: 94) | | 8 |
| | CAAAtTATCCCTGCTGACCCTGG | (SEQ ID NO: 95) | T2075I | 6 |
| | CAAACTATtCCTGCTGACCCTGG | (SEQ ID NO: 96) | P2076I | 1 |
| | CAAACTATCCtTGCTGACCCTGG | (SEQ ID NO: 97) | P2077R | 1 |
| | CAAAtTATtCCTGCTGACCCTGG | (SEQ ID NO: 98) | T2075I and silent | 8 |
| R30 | ATGG*C*TGCAGAGCTACGAGGAGG | (SEQ ID NO: 99) | | 5 |
| | ATGGtTGCAGAGCTACGAGGAGG | (SEQ ID NO: 100) | A2064V | 10 |
| | ATGGgTGCAGAGCTACGAGGAGG | (SEQ ID NO: 101) | A2064G | 1 |
| R31 | GACTG*C*AAAAGGCAATGTTCTGG | (SEQ ID NO: 102) | | 1 |
| | GACTGtAAAAGGCAATGTTCTGG | (SEQ ID NO: 103) | A2192V | 1 |
| R32 | CCCAGACCGCATTGA*G*T*G*CTATG | (SEQ ID NO: 104) | | 2 |
| | CCCAGACCGCATTGAGTaCTATG | (SEQ ID NO: 105) | C2185Y | 1 |
| | CCCAGACCGCATTGAaTGCTATG | (SEQ ID NO: 106) | silent | 1 |
| R33 | *CC*TTTGTCTACATTCCCATGGCT | (SEQ ID NO: 107) | | 1 |
| | CCTTTGTCTACATTCCCATGaCT | (SEQ ID NO: 108) | M2063I | 1 |
| R34 | *CC*AGTGGGT*G*TGATAGCT*G*TGGA | (SEQ ID NO: 109) | | 7 |
| | CCAGTGGGTGTGATAGCTGTGaA | (SEQ ID NO: 110) | E2068K | 3 |
| | CCAGTGGGTaTGATAGCTGTGaA | (SEQ ID NO: 111) | E2069K | 2 |
| | CCAGTGGGTaTGATAGCTaTGaA | (SEQ ID NO: 112) | A2068K and V2067M and silent | 4 |
| R35 | *CC*AAGGGAAATGGTTA*G*GTGCTA | (SEQ ID NO: 113) | | 0 |
| | CCAAGGGAAATGGTTAaaTGCTA | (SEQ ID NO: 114) | G2031N | 2 |
| R36 | *CC*TCGAGCGGCTATCC*G*TGGTGT | (SEQ ID NO: 115) | | 3 |
| | CCTCGAGCGGCTATCCGTaaTGT | (SEQ ID NO: 116) | G2021N | 1 |
| | CCTCGAGCGGCTATCCGTaGTGT | (SEQ ID NO: 117) | G2021S | 1 |
| | CCTCGAGCGGCTATCCaTaaTGT | (SEQ ID NO: 118) | G2021N and R2020Q | 1 |
| R37 | *CC*TGAGAACTCGTGT*G*ATCCTCG | (SEQ ID NO: 119) | | 1 |
| | CCTGAGAACTCGTGTaaATCCTCG | (SEQ ID NO: 120) | D2014N | 1 |
| | CCTGAGAACTCGTaTaATCCTCG | (SEQ ID NO: 121) | C2013Y and D2014N | 2 |

TABLE 2-continued

Analysis of nucleotide and amino acid substitutions targeted 38 sites targeting OsACCase.
Nucleotide substitution out of spacer sequence and mosaic mutations were not included
in this table. The targeted cytosines or
quanines are in italic and the nucleotides substituted by the PBE are in bold.

| Target site | Target site sequences | | Types of amino acid substitution | No. of alleles |
|---|---|---|---|---|
| R38 | CCTGTTGCATACATTCCTGAGAA | (SEQ ID NO: 122) | | 4 |
| | CCTGTTGCATACATTCCTaAGAA | (SEQ ID NO: 123) | E2010K | 1 |
| | CCTGTTGCATACATTCCTaAaAA | (SEQ ID NO: 124) | E2010K | 3 |
| R39 | CCGTTGGACCCACCGGACAGACC | (SEQ ID NO: 125) | | 1 |
| | CCGTTGGACCCACCGaACAGACC | (SEQ ID NO: 126) | D2002N | 1 |
| R40 | CCTATTATTCTTACAGGCTATTC | (SEQ ID NO: 127) | | 1 |
| | CCTATTATTCTTACAGaCTATTC | (SEQ ID NO: 128) | G1932D | 1 |

Example 5: Targeted Mutagenesis in Rice Dihydroxyacid Dehydratase (DHAD)

DHAD is an essential and highly conserved enzyme among plant species that catalyzes β-dehydration reactions to yield α-keto acid precursors to isoleucine, valine and leucine. Recently, a natural-product herbicide has been discovered that targets DHAD (Yan, et al. 2018. 'Resistance-gene-directed discovery of a natural-product herbicide with a new mode of action', Nature, 559: 415-18.). To generate diverse mutants resistant to herbicides that inhibit DHAD, 16 sgRNAs are designed to target the whole coding sequence of rice DHAD (SEQ ID NO: 172). Constructs with base editor and multiplex sgRNAs expression cassettes are generated using method in Example 3 and these constructs are transformed into rice calli using either *Agrobacterium*-mediated transformation or biolistic delivery. A handful of the transgenic M0 plants are regenerated and sequence analyzed for base substitutions within the editing window. As described in Example 3, the M0 plants are outcrossed to wildtype rice plants and the F1 and/or F2 progenies are screened for herbicide resistance using DHAD inhibitor aspterric acid.

In order to target the active site revealed in a structural analysis of *Arabidopsis* DHAD (Yan et al. 2018, vide supra), the base editor consisting of adenine deaminase and xCas9 domain is used. In this case 11 guides are designed covering most of the amino acid residues in and surrounding the active site. Using the same cloning and screening strategy as mentioned above, this population is also screened for herbicide resistance using DHAD inhibitor aspterric acid.

Example 6: Targeted Mutagenesis in Wheat Sucrose Synthase (SUS) Regulatory Domain The sucrose synthase catalyzes the conversion of sucrose into fructose and UDP-glucose, which is linked to starch biosynthesis. As starch is the main component in dry seeds of wheat, starch synthesis has significant effects on yield. Structure analysis of *Arabidopsis* Sucrose synthase-1 revealed that the N terminal regulatory domain is involved in multiple interface interaction (Zheng, Yi, et al. 2011. 'The Structure of Sucrose Synthase-1 from *Arabidopsis thaliana* and Its Functional Implications', Journal of Biological Chemistry, 286: 36108-18.). Based on this, the regulatory domain of wheat SUS1 (focusing on conserved amino acid residues involved in phosphorylation and interface interaction in the tetramer) is targeted for mutagenesis by base editing to discover novel alleles that produce optimized yield (SEQ ID NO: 173). A total of 12 sgRNAs are designed to introduce multiple mutations of the conserved amino acids. Multiplex sgRNA expression and screening strategy II are used to screen mutant with optimized yield.

Example 7: Targeted Mutagenesis of SlCLV3 Promoter Region

It has been reported that using CRISPR/Cas9 for targeted mutagenesis of the SlCLV3 promoter generates novel cis-regulatory alleles for quantitative variation (Rodríguez-Leal et al. 2017, vide supra). The same gene is targeted here using base editor. A total of 14 sgRNAs are designed targeting the promoter region of SlCLV3, 2 kb upstream of the coding sequence (SEQ ID NO: 174), without considering any predicted cis-regulatory elements. Base editor and multiplex sgRNA expression constructs are transformed into S. lyc by *Agrobacterium*-mediated transformation (Gupta, Sarika, et al. 2016. 'Modification of plant regeneration medium decreases the time for recovery of *Solanum lycopersicum* cultivar M82 stable transgenic lines', Plant Cell, Tissue and Organ Culture (PCTOC), 127: 417-23; Rodríguez-Leal et al. 2017, vide supra; and Čermák et al., 2017, vide supra). Five to ten transgenic M0 plants are regenerated are sequence analyzed for base substitutions at sites within the editing window. The F1 and/or F2 progenies from cross of M0 transgenic and wildtype plants are screened for fruit size and locule number.

Example 8

Figure 4A:
FIG. 4: Base editing of STEMEs via fused cytidine and adenosine deaminases. (a) Architectures of STEME-1, STEME-2, STEME-3, and STEME-4. Abbreviations: ecTadA7.10: evolved *Escherichia coli* TadA; aa: amino acid; XTEN: a 16 aa linker. (b) Comparison of the C>T editing frequencies of A3A-PBE and the four STEME constructs (n=3). (c) Comparison of the A>G editing frequencies of PABE-7 and the four STEME constructs (n=3).

To generate both C:G>T:A and A:T>G:C substitutions in the same target sequence using a single protein, the inventors fused APOBEC3A-ecTadA65ecTadA7.10 or ecTadA-ecTadA7.10-APOBEC3A to the N terminus of nCas9 (D10A), together with UGI or two copies of free UGI at the C terminus of nCas9 (D10A), generating STEME-1, STEME-2, STEME-3, and STEME-4, respectively (FIG. 4a). The STEMEs were codon optimized for crop plants, and driven by the Ubi-1 promoter of maize. To examine their base editing activities on endogenous genes, six sgRNAs targeting different rice genes were designed and cloned into pOsU3-esgRNA.

Figure 4B:
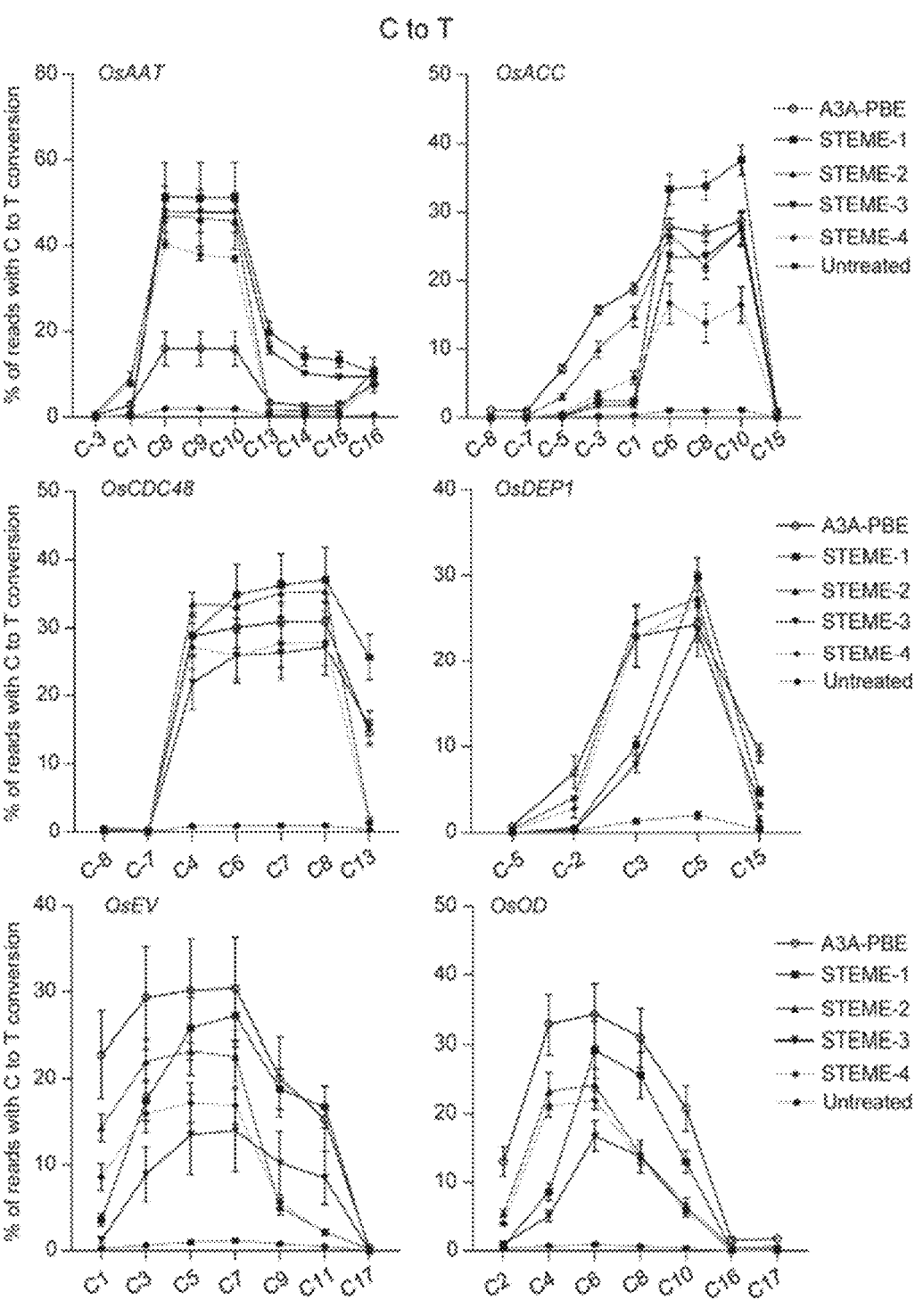
Figure 4C:
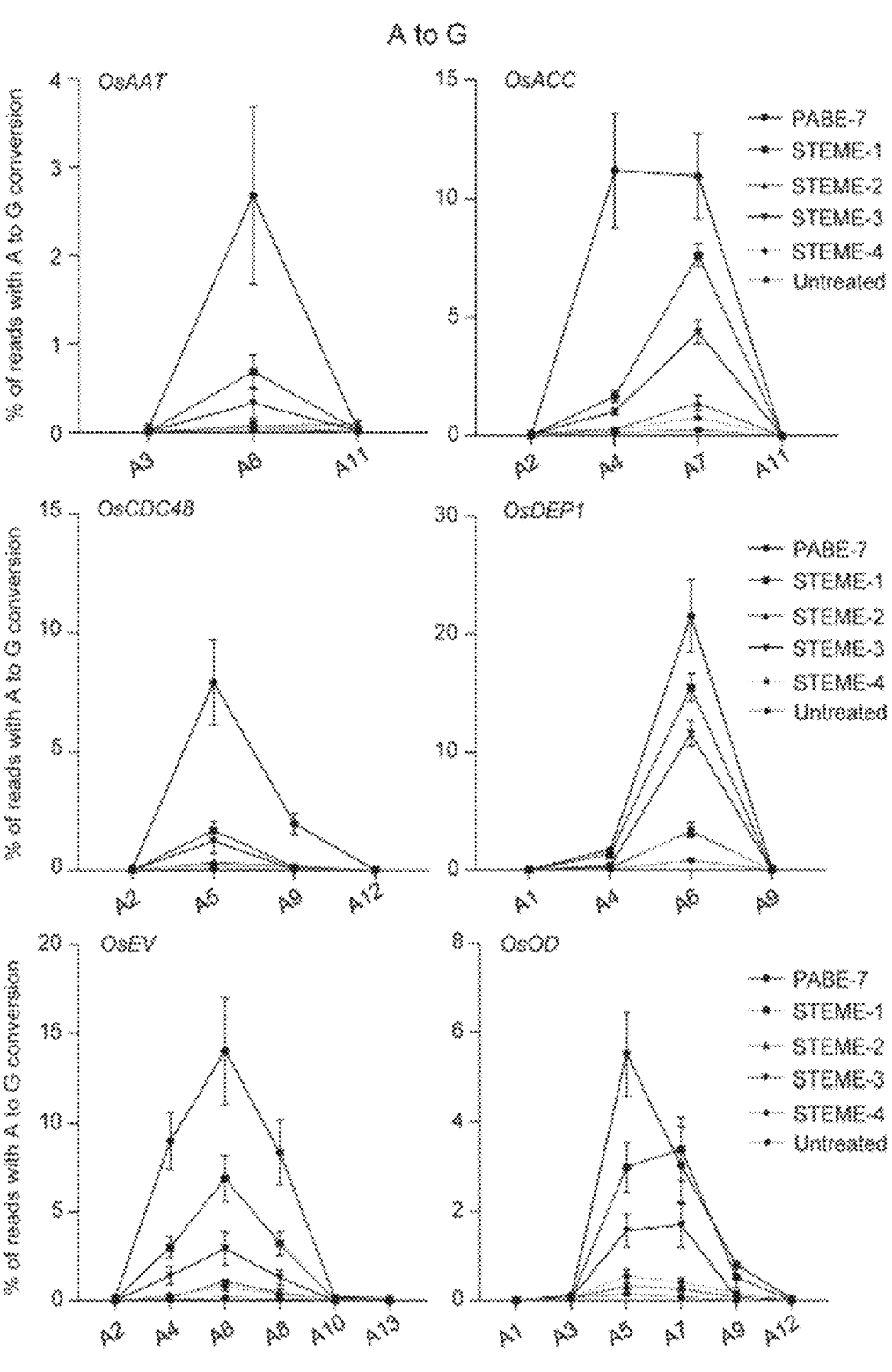

Each sgRNA was co-transfected into rice protoplasts along with each of the four STEMEs. A3A-PBE, PABE-7, and wild-type Cas9 were used as controls. Amplicon deep sequencing showed that all four STEMEs produced C>T and A>G conversions efficiently (FIG. 4 b,c). The C>T base editing windows were equivalent to that of A3A-PBE and the editing efficiencies ranged from 0.10-61.61%, with STEME-1 the most efficient (FIG. 4 b). Within the primary editing window of A3A-PBE (C1-C17; counting the end distal to the PAM as position 1), STEME-1 had a C>T editing efficiency averaging 25.14% in OsAAT, OsACC, OsCDCl48, and OsDEP1 that was 1.5-fold higher than A3A-PBE (average 17.25%) (FIG. 4 c).

STEME-1 also had the highest A>G base editing efficiency (0.69-15.50%) amongst the four STEMEs and the A>G base editing window of A4 to A8. Although this was lower than PABE-7 (1.74-21.54%), the STEME-1 A>G editing efficiency was still within an acceptable threshold to provide the desired diversity for an improved directed evolution strategy (FIG. 4 c). Moreover, in over 99% of the instances of A>G substitution by STEME-1, this was accompanied by simultaneous C>T editing in the same DNA strand. No undesired editing at any of the sgRNA targets was apparent (<0.05%). Indel frequencies with STEMEs (0.04-0.63%) were also equivalent to that in untreated control protoplasts (0.04-0.51%), much lower than with Cas9 (6.30-15.61%). These results indicate that the STEMEs induce both C>88 T and A>G conversions using only one sgRNA and that STEME-1 is effective at generating simultaneous mutations to increase the diversity of mutations at a target site.

Figure 5A:
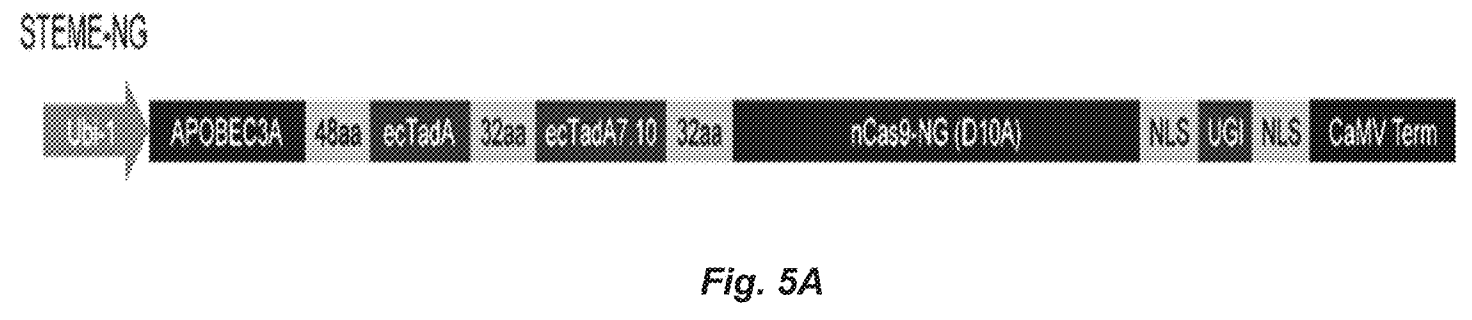

Next, to expand the targeting scope of STEME-1 in order to increase its utility, the nCas9 (D10A) in STEME-1 was replaced with codon-optimized nCas9-NG (D10A) to produce STEME-NG (FIG. 5a). It was also generated A3A-PBE-NG (DNA=SEQ ID NO: 185; protein=SEQ ID NO: 186), PABE7-NG (DNA=SEQ ID NO: 187; protein=SEQ ID NO: 188), and pCas9-NG (DNA=SEQ ID NO: 189; protein=SEQ ID NO: 190) constructs by replacing the corresponding portions of A3A-PBE, PABE-7, and pCas9 with codon-optimized nCas9-NG (D10A) or Cas9-NG. It has been designed sixteen 20-nt spacers with NG PAMs from four different rice loci. STEME-NG along with each of these sixteen sgRNAs was then co-transfected into rice protoplasts. Is has been found that STEME-NG had a broad capacity for editing C>T and A>G in NG PAM sequences, but preferred NGD (D=A, T or G) PAMs. Like Cas9-NG24, STEME-NG exhibited compromised activity (average C>T 7.92%, A>G 1.84%) at canonical NGG PAM sequences compared with STEME-1 (average C>T 17.89%, A>G 3.80%). STEME-NG edited cytosines in a window of C1 to C17 and adenines in a window of A4 to A8, which was the same as observed for the individual A3A-PBE-NG and PABE7-NG, respectively. In addition, STEME-NG, A3A-PBE-NG, and PABE7-NG generated indels at much lower frequencies (<0.10%) than pCas9-NG (0.16-13.24%) in rice protoplasts. Taken together, these data show that the editing activities of STEME-NG, A3A-PBE-NG, and PABE7-NG at NG PAMs depend mainly on the nature of the Cas9-NG. Although the editing efficiency of STEME-NG was on average 2.2-fold lower than that of STEME-1 on NGG PAM, the above data suggests that STEME-NG is able to expand the scope of C>T and A>G base editing and facilitate the application of directed evolution in plants.

Example 9

Figure 5B:
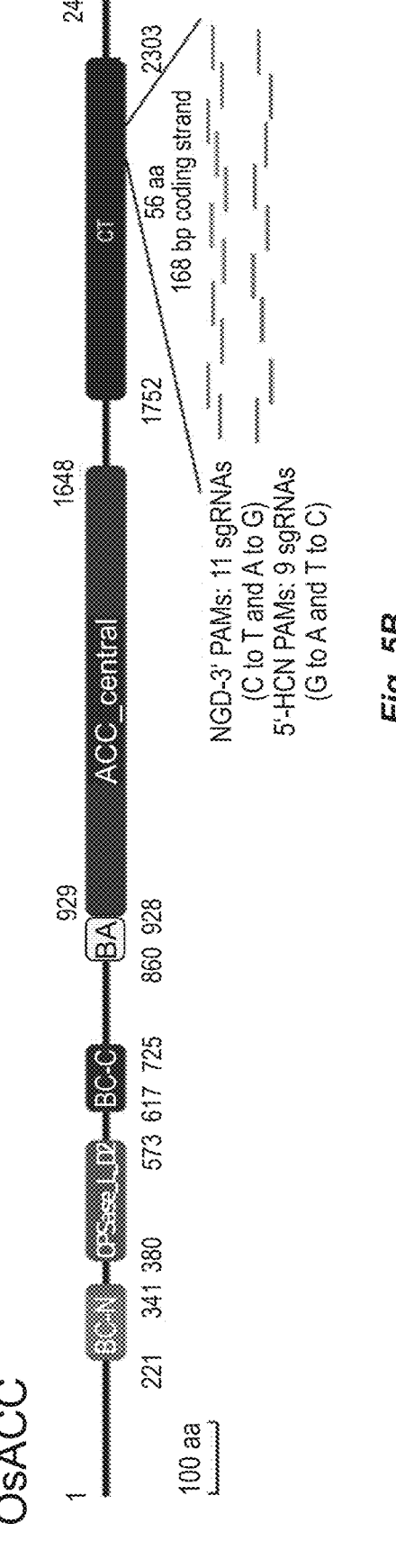

To test the ability of STEME to achieve saturated de novo mutagenesis in rice protoplasts, it has been taken acetyl-coenzyme A carboxylase (OsACC) as an example. ACC is a key enzyme in lipid biosynthesis and its carboxyltransferase (CT) domain is the target of herbicides (FIG. 5 b). Amino acid substitutions in the CT domain can confer herbicides resistance on grass. 20 sgRNAs has been designed, including 11 sgRNAs with forward direction NGD-3' PAMs and 9 with reverse complement 5'-HCN (H=A, T or C) PAMs spanning a 168 bp DNA sequence that encodes 56 amino acids of the CT domain (FIG. 5b). Using STEME-NG, the sgRNAs covered 90.32% of the cytosines, 40.43% of the adenines, 77.78% of the guanines, and 38.89% of the thymines in the editing windows, corresponding in all to 61.31% of the bases of the coding strand. These sgRNAs has been co-transfected individually together with STEME-NG into rice protoplasts. A3A-PBE-NG and pCas9-NG served as controls. Amplicon deep sequencing showed that STEME-NG converted 96.43% of the Cs to Ts, 63.16% of the As to Gs, 92.86% of the Gs to As, and 42.86% of the Ts to Cs in the covered bases on the coding strand; average base editing efficiencies were 11.50%, 0.35%, 13.33%, and 0.45%, respectively. Meanwhile, A3A-PBE-NG edited 89.29% of Cs to Ts and 92.86% of Gs to As on the coding strand, and no A>G or T>C substitutions were found. No base conversions were detected in the untreated control. The diversity of mutations induced by these 20 sgRNAs using STEME-NG was about two-fold greater than that observed using A3A-PBE-NG. Simultaneous C:G>T:A and A:T>G:C events contributed to 18.4% of the observed STEME-NG diversity, efficiency up to 2.71%. Consistent with the above experiments STEME-NG showed in untreated control protoplasts of indels (<0.02%) with this different target set, similar to A3A-PBE-NG (<0.01%) and much less than Cas9-NG (0.32-39.72%).

We also analyzed the amino acid substitutions generated by STEME-NG in the targeted 56 amino acids. We found that 41 of the amino acids were substituted (including silent mutations, missense mutations, and nonsense mutations). Of these, twenty-four, twelve, and five amino acids had one, two, and three kinds of amino acids substitution, respectively. Thus, nearly-saturated mutagenesis (73.21%) occurred over the 56 amino acids using STEME-NG and only 20 sgRNAs. Similarly, A3A-PBE-NG mutated 33 amino acids, of which twenty-six, six, and one contained one, two, and three kinds of amino acids substitution, respectively. These results collectively show that STEME-NG can induce diverse mutation types in rice coding sequence. Thus, it promises to be a powerful tool for directed evolution of endogenous genes by saturated de novo mutagenesis in situ.

Example 10

As proof-of-concept, STEMEs has been used for directed evolution of ACC in rice plants. A 1,200-nt region encoding 400 aa of the CT domain was chosen as the mutagenesis target. A total of 200 sgRNAs were designed, including 118 forward direction NGD-3' and 82 reverse complement 5'-HCN PAM sgRNAs. STEME-1 was chosen for 102 sgRNAs with NGG-3' or 5'-CCN PAMs, while STEME-NG was used for the remaining sgRNAs, which had NGW-3' or 5'-WCN (W=A or T) PAMs. These sgRNAs covered 94.61% of the Cs, 48.26% of the As, 83.39% of the Gs, and 37.46% of the Ts in the editing windows, representing in all 63.95% of the bases on the coding strand. It has been inserted these sgRNAs separately into the binary vector pH-STEME-1-esgRNA or pH-STEME-NG-esgRNA. To perform plant transformation and genotyping efficiently, the 200 sgRNAs were divided into 27 groups (Groups 1-27). In each group, equal amounts of 4 to 11 sgRNA plasmids covering 80-142 nt in OsACC were pooled.

To evaluate the transformation coverage, the guide RNA sequences from genomic DNA extracted from each group of regenerated seedlings were amplified for amplicon deep sequencing. It has been found that 72.73% to 100% of the sgRNAs had been transformed into the plants in each group, and in total 92.50% (185/200) of the sgRNAs had been successfully introduced. The mutational coverage was characterized by deep sequencing and observed 377 nucleotide substitutions among the 768 nucleotides covered, involving 168 Cs (73.68%), 23 As (15.03%), 164 Gs (61.65%), and 22 Ts (18.18%). The average editing efficiency in each group was 13.18%. Moreover, unlike the uniform substitutions seen in protoplasts, the STEMEs induced C>G/A, G>C/T conversions and in-frame indels in addition to the canonical C:G>T:A and A:T>G:C base conversions. The product distributions among the edited bases were 81.86% C>T, 13.73% C>G, 4.41% C>A, 76.63% G>A, 19.02% G>C, 4.35% G>T, 100% A>G, and 100% T>C; this somewhat altered distribution may be due to differences in base excision repair mechanisms in protoplasts and plants. Thus, STEMEs can also be used to generate C:G>G:C or C:G>A:T substitutions in addition 176 to the canonical edits, which should enhance the diversity in protein directed evolution in plants.

It has been analyzed the details of the mutational reads created in the rice plants. Of the 495 types of mutational reads induced by the 185 sgRNAs, 76.36%, 19.80%, 3.64%, and 0.20% involved one, two, three, and four amino acids substitutions, respectively. In addition, 2.83% of the mutated sequences involved A:T>G:C changes and 3.84% involved simultaneous A:T>G:C and C:G>T:A changes. Of the 400 amino acids targeted, 209 (52.25%) were altered, generating silent, missense, and nonsense mutations (FIG. 6 *d*). Of these, 116, 66, 19, 7, and 1 had one, two, three, four, and six kinds of amino acids substitutions, respectively (FIG. 6 *d*). Taken together, these data demonstrate that STEMEs are able to generate large numbers 185 of mutations to serve as the basis for directed evolution of endogenous genes in the rice genome.

Example 11

To identify the desired mutants, a commonly used ACC inhibitor, haloxyfop, has been sprayed to select for herbicide resistance seedlings in Groups 1 to 27. Three weeks later a few normal-looking seedlings appeared and were clearly herbicide resistant. Sanger sequencing showed that ten in Group 6 carried mutations: seven were P1927F homozygotes and two were heterozygotes, and the remaining seedling was a Q1926*/P1927F and P1927F biallelic mutant; two seedlings in Group 20 carried mutations: one was a W2125C homozygote, and the other a A2123T/W2125C heterozygote. It has been observed other seedlings with a slightly weaker haloxyfop resistance than that observed above, suggesting these may represent different alleles. Sanger sequencing showed that two of the seedlings, in Group 2, were S1866F heterozygotes whereas three seedlings in Group 3 were A1884P heterozygotes. In all plants containing either the S1866F, P1927F or A2123T substitutions, these were the result of C:G>T:A transitions, whereas a C:G>G:C transversion was responsible for all observed W2125C substitutions. This was consistent with the amplicon data of STEMEs in rice plants, showing the occurrence of C:G>G:C transversions. In contrast, the A1884P substitutions observed were caused by different activities; two plants contained a single C:G>G:C transversions whereas the third plant contained both a C:G>G:C transversion and A:T>G:C transition within the A1884P codon indicative of simultaneous deaminase activities from STEME-NG. W2125C is a herbicide resistance mutation, which has been reported in grasses (Powles, S. B. & Yu, Q. Evolution in action: plants resistant to herbicides. Annu. Rev. Plant. Biol. 61, 317-347 (2010).), indicating that mutagenesis of ACC by STEMEs are able to generate known mutations. Importantly, these results also confirmed that STEMEs can generate multiple novel mutations, such as P1927F, S1866F, and A1884P, which have not been reported previously.

Example 12

It has been tested a strategy of using STEMEs for targeted mutagenesis under concurrent selection pressure. Based on the above results, Group 6 (P1927) and Group 20 (W2125) were selected as representative targets and used to transform rice with a modified protocol in which the herbicide selection pressure was applied during callus induction and regeneration. Vigourous growth of calli was observed in the target transformations, whereas calli transformed with the control vector died.

Twenty plants each from the Group 6 and Group 20 transformations were selected for further analysis and all carried the expected P1927F or W2125C mutations, respectively. Three of twenty mutants carrying W2125C also contained A2123T mutations with nucleotide changes resulting from simultaneous adenosine and cytidine deaminase activity within the A2123 codon. In addition, we also sequenced the OsACC gene of representative resistance seedlings harboring P1927F, W2125C, S1866F, or A1884P and found no other mutational changes. Therefore, mutagenesis of OsACC by STEMEs can reveal a range of new functional herbicide resistance mutations in addition to previously described mutations, demonstrating their potential value in carrying out directed protein evolution.

To evaluate the potential for off-target effects, it was scanned the genomic sequence for all similar target sites that contained up to a 3-nt mismatch and sequenced these sites in the respective mutants. From this analysis, a single off-target mutation was found in only one of the mutants (the biallelic mutant harboring A2123T and A2123T/W2125C) whereas no off-target mutations were found in any of the other mutants.

Plasmids Construction.

The cytidine deaminase, adenosine deaminase, nCas9 (D10A) and UGI portions of STEME-1, STEME-2, STEME-3, and STEME-4 were amplified from from A3A-PBE or PABE-7, and assembled into the pJIT163 backbone by One Step Cloning (ClonExpress II One Step Cloning Kit, Vazyme, Nanjing, China). PCR was performed using TransStart FastPfu DNA Polymerase (TransGen Biotech). The Cas9 variant nCas9-NG (D10A) containing R1335V/L1111R/D1135V/G1218R/E1219F/A1322R/T1337R substitutions was synthesized commercially (GENEWIZ, Suzhou, China). The sgRNA construct pOsU3-esgRNA was previously described (Li, C. et al. Expanded base editing in rice and wheat using a Cas9-adenosine deaminase fusion. Genome Biol. 19, 59 (2018).). Annealed oligos were inserted into BsaI (New England BioLabs)-digested pOsU3- esgRNA. To construct the pH-STEME-1-esgRNA and pH-STEME-NG-esgRNA binary vectors, STEME-1 and STEME-NG along with the OsU3-esgRNA expression cassette were cloned into the pHUE411 backbone31. All the primer sets were synthesized by Beijing Genomics Institute (BGI).

Protoplast Transfection.

We used the *Japonica* rice variety Nipponbare to prepare protoplasts. Protoplast isolation and transformation were performed as described (Shan, Q. et al. Rapid and efficient gene modification in rice and *Brachypodium* using TALENs. Mol. Plant 6, 1365-1368 (2013).). 10 μg each of nuclease and sgRNA plasmid DNA were introduced into the protoplasts by PEG-mediated transfection, with a mean transformation efficiency of 40-55% as measured by hemocytometer. The transfected protoplasts were incubated at 23° C. and 60 h post-transfection they were collected and genomic DNA extracted for amplicon deep sequencing.

*Agrobacterium*-Mediated Transformation of Rice Callus Cells.

The binary vectors for each group were pooled in equimolar ratios and transformed into *A. tumefaciens* AGL1 by electroporation and used to transform about 240 rice calli. *Agrobacterium*-mediated transformation of callus cells of the *Japonica* rice variety Zhonghua11 was conducted as reported32,33. Hygromycin (50 μg/ml) was used to select transgenic plants.

Screening for Herbicide Tolerance.

T0 regenerated rice seedlings were transferred to water, grown in a growth chamber (25° C., 16 h light and 8 h dark) for ten days and sprayed with haloxyfop (34 g active ingredient ha-1). The herbicide was applied with pressurized equipment at 0.2 MPa and a spray volume of 450 L/ha. Three weeks later, surviving seedlings were identified.

Selection of Haloxyfop-Resistant Seedlings in the Medium.

After transformation, the calli were selected on callus induction medium supplemented with hygromycin (50 μg/ml) for four weeks. Then the hygromycin-resistant calli were transferred to callus induction medium supplemented with haloxyfop (0.108 mg/L). After six weeks selection, the fresh and bright calli were transferred to regeneration medium supplemented with haloxyfop (0.108 mg/L) for regeneration.

DNA extraction. The genomic DNA of protoplasts was extracted with a DNA-Quick Plant System (Tiangen Biotech, Beijing, China). Genomic DNA of regenerated rice seedlings was extracted with CTAB, and all the seedlings in each group were sampled together. The targeted site was amplified with specific primers, and the amplicons were purified with an EasyPure PCR Purification Kit (TransGen Biotech, Beijing, China), and quantified with a NanoDrop™ 2000 Spectrophotometer (Thermo Fisher Scientific, Waltham, MA, USA).

Detection of Likely Off-Target Sites.

The potential off-target sites were predicted using the online tool Cas-OFFinder (Bae, S., Park, J. & Kim, J.-S. Cas-OFFinder: a fast and versatile algorithm that searches for potential off-target sites of Cas9 RNA-guided endonucleases. Bioinformatics 30, 1473-1475 (2014).). If the on-target sgRNA with a NGG PAM the off-target sites were predicted using NGG PAM. Alternatively, the on-target sgRNA with a NG PAM the off-target sites were predicted using NG PAM. The off-target sites containing up to 3-nt mismatches were examined in above examples.

SEQUENCE LISTING (193 sequences)

SEQ ID NO: 1 - DNA, 23 bp, Artificial Sequence
  R1 wild type
ccagtgcttattctagggcatat

SEQ ID NO: 2 - DNA, 23 bp, Artificial Sequence
  R1 target site silent mutation
ccagtgcttattctagagcatat

SEQ ID NO: 3 - DNA, 23 bp, Artificial Sequence
  R1 target site R1891S
ccagtgcttattctagcgcatat

SEQ ID NO: 4 - DNA, 23 bp, Artificial Sequence
  Target site R1891T mutation
ccagtgcttattctacagcatat

SEQ ID NO: 5 - DNA, 23 bp, Artificial Sequence
  Target site R1891K mutation
ccagtgcttattctaaagcatat

SEQ ID NO: 6 - DNA, 23 bp, Artificial Sequence
  target site A1892T mutation
ccagtgcttattctagaacatat

SEQ ID NO: 7 - DNA, 23 bp, Artificial Sequence
  mutated target site R1891K and A1892T
ccagtgcttattctaaaacatat

SEQ ID NO: 8 - DNA, 23 bp, Artificial Sequence
  wild type target site
ccggtgcatacagcgtcttgacc

SEQ ID NO: 9 - DNA, 23 bp, Artificial Sequence
  mutated target site D1925N
ccggtgcatacagcgtcttaacc

SEQ ID NO: 10 - DNA, 23 bp, Artificial Sequence
  mutated target site D1925H
ccggtgcatacagcgtcttcacc

SEQ ID NO: 11 - DNA, 23 bp, Artificial Sequence
  wild type target site
tctgcactgaacaagcttcttgg

SEQ ID NO: 12 - DNA, 23 bp, Artificial Sequence
  mutatetd target site A1935V
tctgtactgaacaagcttcttgg

SEQ ID NO: 13 - DNA, 23 bp, Artificial Sequence
  mutated target site silent
tctgcattgaacaagcttcttgg

SEQ ID NO: 14 - DNA, 23 bp, Artificial Sequence
  mutated target site S1934F
tttgcactgaacaagcttcttgg

SEQ ID NO: 15 - DNA, 23 bp, Artificial Sequence
  wild type target site
ccacatgcagttgggtggtccca

SEQ ID NO: 16 - DNA, 23 bp, Artificial Sequence
  mutated target site G1953N
ccacatgcagttgggtaatccca

SEQ ID NO: 17 - DNA, 23 bp, Artificial Sequence
  mutated target site G1953D
ccacatgcagttgggtgatccca

SEQ ID NO: 18 - DNA, 23 bp, Artificial Sequence
  mutated target site G1953S
ccacatgcagttgggtagtccca

SEQ ID NO: 19 - DNA, 23 bp, Artificial Sequence
  mutated target site G1953A
ccacatgcagttgggtgctccca

SEQ ID NO: 20 - DNA, 23 bp, Artificial Sequence
  mutated target site G1953H
ccacatgcagttgggtcatccca

SEQ ID NO: 21 - DNA, 23 bp, Artificial Sequence
  mutated target site G1953T
ccacatgcagttgggtactccca

SEQ ID NO: 22 - DNA, 23 bp, Artificial Sequence
  wild type target site
ccatcttactgtttcagatgacc

SEQ ID NO: 23 - DNA, 23 bp, Artificial Sequence
  mutated target site D1969N
ccatcttactgtttcaaatgacc

SEQ ID NO: 24 - DNA, 23 bp, Artificial Sequence
  mutated target site D1969H
ccatcttactgtttcacatgacc

SEQ ID NO: 25 - DNA, 23 bp, Artificial Sequence
  mutated target site D1969N and D1970N
ccatcttactgtttcaaataacc

SEQ ID NO: 26 - DNA, 23 bp, Artificial Sequence
  mutated target site D1969H and D1970N
ccatcttactgtttcacataacc

SEQ ID NO: 27 - DNA, 23 bp, Artificial Sequence
  wild type target sequence
ccctgctgaccctggtcagcttg

SEQ ID NO: 28 - DNA, 23 bp, Artificial Sequence
  mutated target sequence D2084N
ccctgctgaccctggtcagctta

SEQ ID NO: 29 - DNA, 23 bp, Artificial Sequence
  mutatetd target sequence D2084H
ccctgctgaccctggtcagcttc

SEQ ID NO: 30 - DNA, 23 bp, Artificial Sequence
  mutated target site G2081D
ccctgctgaccctgatcagcttg

SEQ ID NO: 31 - DNA, 23 bp, Artificial Sequence
  mutated target site D2079N, G2081D
ccctgctaaccctgatcaacttg

SEQ ID NO: 32 - DNA, 23 bp, Artificial Sequence
  wild type target sequences
ttcctcgtgctggacaagtgtgg

SEQ ID NO: 33 - DNA, 23 bp, Artificial Sequence
  mutated target sequences P2091S
tttctcgtgctggacaagtgtgg

SEQ ID NO: 34 - DNA, 23 bp, Artificial Sequence
  mutated target sequence P2091F
tttttcgtgctggacaagtgtgg

SEQ ID NO: 35 - DNA, 23 bp, Artificial Sequence
  mutated target site P2091F, R2092C
ttttttgtgctggacaagtgtgg

SEQ ID NO: 36 - DNA, 23 bp, Artificial Sequence
  mutated target site P2091L, R2092C
ttctttgtgctggacaagtgtgg

SEQ ID NO: 37 - DNA, 23 bp, Artificial Sequence
  mutated target site R2092C
ttccttgtgctggacaagtgtgg

SEQ ID NO: 38 - DNA, 23 bp, Artificial Sequence
  mutated target site P2091V
ttgttcgtgctggacaagtgtgg

SEQ ID NO: 39 - DNA, 23 bp, Artificial Sequence
  mutated target site P2091C, R2092C
tttgttgtgctggacaagtgtgg

SEQ ID NO: 40 - DNA, 23 bp, Artificial Sequence
  wild type target site
caagactgcgcaggcattgctgg

SEQ ID NO: 41 - DNA, 23 bp, Artificial Sequence
  mutated target site T2105I
caagattgcgcaggcattgctgg

SEQ ID NO: 42 - DNA, 23 bp, Artificial Sequence
  mutated target site R2126K
cctcgctaactggagaggcttct

SEQ ID NO: 43 - DNA, 23 bp, Artificial Sequence
  mutated target site W2125STOP
cctcgctaactgaagaggcttct

SEQ ID NO: 44 - DNA, 23 bp, Artificial Sequence
  mutated target site W2125C
cctcgctaactgcagaggcttct

SEQ ID NO: 45 - DNA, 23 bp, Artificial Sequence
  mutated target site W2125C, R2126K
cctcgctaactgcaaaggcttct

SEQ ID NO: 46 - DNA, 23 bp, Artificial Sequence
  mutated target site W2125C, G2127N
cctcgctaactgcagaaacttct

SEQ ID NO: 47 - DNA, 23 bp, Artificial Sequence
  wild type target site
cgactattgttgagaaccttagg

SEQ ID NO: 48 - DNA, 23 bp, Artificial Sequence
  mutated target site T2145I
cgattattgttgagaaccttagg

SEQ ID NO: 49 - DNA, 23 bp, Artificial Sequence
  wild type
ccatggctgcagagctacgagga

SEQ ID NO: 50 - DNA, 23 bp, Artificial Sequence
  mutated target site R2168Q
ccatggctgcagagctacaagga

SEQ ID NO: 51 - DNA, 23 bp, Artificial Sequence
  mutated target sequence R2168Q G2169E
ccatggctgcagagctacaagaa

SEQ ID NO: 52 - DNA, 23 bp, Artificial Sequence
  mutated target sequence E2166K
ccatggctgcaaagctacaagga

SEQ ID NO: 53 - DNA, 23 bp, Artificial Sequence
  wild type
ccgcattgagtgctatgctgaga

SEQ ID NO: 54 - DNA, 23 bp, Artificial Sequence
  mutated target sequence silent
ccgcattgagtgctatgctgaaa

SEQ ID NO: 55 - DNA, 23 bp, Artificial Sequence
  mutated target sequence E2189K
ccgcattgagtgctatgctaaga

SEQ ID NO: 56 - DNA, 23 bp, Artificial Sequence
  mutated target sequence E2189K
ccgcattgagtgctatgctaaaa

SEQ ID NO: 57 - DNA, 23 bp, Artificial Sequence
  mutated target sequence E2189Q
ccgcattgagtgctatgctcaaa

SEQ ID NO: 58 - DNA, 23 bp, Artificial Sequence
  mutated target sequence E2189N
ccgcattgagtgctatgctaaca

SEQ ID NO: 59 - DNA, 23 bp, Artificial Sequence
  wild type
tatgctgagaggactgcaaaagg

SEQ ID NO: 60 - DNA, 23 bp, Artificial Sequence
  mutated target sequence A2188V
tatgttgagaggactgcaaaagg

SEQ ID NO: 61 - DNA, 23 bp, Artificial Sequence
  wild type
ccaggattgcatgagtcggcttg

SEQ ID NO: 62 - DNA, 23 bp, Artificial Sequence
  mutated target sequence M2126I
ccaggattgcataagtcggcttg

SEQ ID NO: 63 - DNA, 23 bp, Artificial Sequence
  mutated target sequence M2126I
ccaggattgcatgagtcagcttg

SEQ ID NO: 64 - DNA, 23 bp, Artificial Sequence
  wild type
ggagcttatcttgctcgacttgg

SEQ ID NO: 65 - DNA, 23 bp, Artificial Sequence
  mutated target sequence A1911V
ggagtttatcttgctcgacttgg

SEQ ID NO: 66 - DNA, 23 bp, Artificial Sequence
  mutated target sequence L1913F
ggagcttattttgctcgacttgg

SEQ ID NO: 67 - DNA, 23 bp, Artificial Sequence
  mutated target sequence L1913V
ggagcttatgttgctcgacttgg

SEQ ID NO: 68 - DNA, 23 bp, Artificial Sequence
  wild type
ccgcaagggttaattgagatcaa

SEQ ID NO: 69 - DNA, 23 bp, Artificial Sequence
  mutated target sequence silent
ccgcaagggttaattgaaatcaa

SEQ ID NO: 70 - DNA, 23 bp, Artificial Sequence
  mutated target sequence E2204K
ccgcaagggttaattaaaatcaa

SEQ ID NO: 71 - DNA, 23 bp, Artificial Sequence
  wild type
tgcttattctagggcatataagg

SEQ ID NO: 72 - DNA, 23 bp, Artificial Sequence
  mutated target sequence S1890F
tgcttattttagggcatataagg

SEQ ID NO: 73 - DNA, 23 bp, Artificial Sequence
  wild type
tttacacttacatttgtgactgg

SEQ ID NO: 74 - DNA, 23 bp, Artificial Sequence
  mutated target sequence T1898I
tttatacttacatttgtgactgg

SEQ ID NO: 75 - DNA, 23 bp, Artificial Sequence
  mutated target sequence L1899F
tttacatttacatttgtgactgg

SEQ ID NO: 76 - DNA, 23 bp, Artificial Sequence
  wild type
agctcccacatgcagttgggtgg

SEQ ID NO: 77 - DNA, 23 bp, Artificial Sequence
  mutated target sequence S1947F
agctttcacatgcagttgggtgg

SEQ ID NO: 78 - DNA, 23 bp, Artificial Sequence
  mutated target sequence S1947F and H1948Y
agcttttacatgcagttgggtgg

SEQ ID NO: 79 - DNA, 23 bp, Artificial Sequence
  wild type
actgtttcagatgaccttgaagg

SEQ ID NO: 80 - DNA, 23 bp, Artificial Sequence
  mutated target sequence S1968L
actgttttagatgaccttgaagg

SEQ ID NO: 81 - DNA, 23 bp, Artificial Sequence
  wild type
gcgtttctaatatattgaggtgg

SEQ ID NO: 82 - DNA, 23 bp, Artificial Sequence
  mutated target sequence S1975F
gcgtttttaatatattgaggtgg

SEQ ID NO: 83 - DNA, 23 bp, Artificial Sequence
  wild type
tatgttcctgcctacattggtgg

SEQ ID NO: 84 - DNA, 23 bp, Artificial Sequence
  mutated target sequence P1985L
tatgttcttgcctacattggtgg

SEQ ID NO: 85 - DNA, 23 bp, Artificial Sequence
  wild type
acttccagtaacaacaccgttgg

SEQ ID NO: 86 - DNA, 23 bp, Artificial Sequence
  mutated target sequence P1993A
acttctagtaacaacaccgttgg

SEQ ID NO: 87 - DNA, 23 bp, Artificial Sequence
  mutated target sequence P1993L
acttttagtaacaacaccgttgg

SEQ ID NO: 88 - DNA, 23 bp, Artificial Sequence
  wild type
aacaacaccgttggacccaccgg

SEQ ID NO: 89 - DNA, 23 bp, Artificial Sequence
  mutated target sequence T1995N
aacaataccgttggacccaccgg

SEQ ID NO: 90 - DNA, 23 bp, Artificial Sequence
  wild type
gaactcgtgtgatcctcgagcgg

SEQ ID NO: 91 - DNA, 23 bp, Artificial Sequence
  mutated target sequence S2012L
gaacttgtgtgatcctcgagcgg

SEQ ID NO: 92 - DNA, 23 bp, Artificial Sequence
  wild type
gttactggcagagcaaagcttgg

SEQ ID NO: 93 - DNA, 23 bp, Artificial Sequence
  mutated target sequence T2052I
gttattggcagagcaaagcttgg

SEQ ID NO: 94 - DNA, 23 bp, Artificial Sequence
  wild type
caaactatccctgctgaccctgg

SEQ ID NO: 95 - DNA, 23 bp, Artificial Sequence
  muatated target sequence T2075I
caaactattcctgctgaccctgg

SEQ ID NO: 96 - DNA, 23 bp, Artificial Sequence
  mutated target sequence P2076I
caaactattcctgctgaccctgg

SEQ ID NO: 97 - DNA, 23 bp, Artificial Sequence
  mutated target sequence P2077R
caaactatccttgctgaccctgg

SEQ ID NO: 98 - DNA, 23 bp, Artificial Sequence
  mutated target sequence T2075I and silent
caaattattcctgctgaccctgg

SEQ ID NO: 99 - DNA, 23 bp, Artificial Sequence
  wild type
atggctgcagagctacgaggagg

SEQ ID NO: 100 - DNA, 23 bp, Artificial Sequence
  mutated target sequence A2064V
atggttgcagagctacgaggagg

SEQ ID NO: 101 - DNA, 23 bp, Artificial Sequence
  mutated target sequence A2064G
atgggtgcagagctacgaggagg

SEQ ID NO: 102 - DNA, 23 bp, Artificial Sequence
  wild type
gactgcaaaaggcaatgttctgg

SEQ ID NO: 103 - DNA, 23 bp, Artificial Sequence
  mutated target sequence A2192V
gactgtaaaaggcaatgttctgg

SEQ ID NO: 104 - DNA, 23 bp, Artificial Sequence
  wild type
cccagaccgcattgagtgctatg

SEQ ID NO: 105 - DNA, 23 bp, Artificial Sequence
  mutated target sequence C2185Y
cccagaccgcattgagtactatg

SEQ ID NO: 106 - DNA, 23 bp, Artificial Sequence
  mutated target sequence silent
cccagaccgcattgaatgctatg

SEQ ID NO: 107 - DNA, 23 bp, Artificial Sequence
  wild type
cctttgtctacattcccatggct

SEQ ID NO: 108 - DNA, 23 bp, Artificial Sequence
  mutated target sequence M2063I
cctttgtctacattcccatgact

SEQ ID NO: 109 - DNA, 23 bp, Artificial Sequence
  wild type
ccagtgggtgtgatagctgtgga

SEQ ID NO: 110 - DNA, 23 bp, Artificial Sequence
  mutated target sequence E2068K
ccagtgggtgtgatagctgtgaa

SEQ ID NO: 111 - DNA, 23 bp, Artificial Sequence
  mutated target sequence E2069K
ccagtgggtatgatagctgtgaa

SEQ ID NO: 112 - DNA, 23 bp, Artificial Sequence
  mutated target sequence A2068K, V2067M, silent
ccagtgggtatgatagctatgaa

SEQ ID NO: 113 - DNA, 23 bp, Artificial Sequence
  wild type
ccaagggaaatggttaggtggta

SEQ ID NO: 114 - DNA, 23 bp, Artificial Sequence
  mutated target sequence G2031N
ccaagggaaatggttaaatggta

SEQ ID NO: 115 - DNA, 23 bp, Artificial Sequence
  wild type
cctcgagcggctatccgtggtgt

SEQ ID NO: 116 - DNA, 23 bp, Artificial Sequence
  mutated target sequence G2021N
cctcgagcggctatccgtaatgt

SEQ ID NO: 117 - DNA, 23 bp, Artificial Sequence
  mutated target sequence G2021S
cctcgagcggctatccgtagtgt

SEQ ID NO: 118 - DNA, 23 bp, Artificial Sequence
  mutated target sequence G2021N, R2020Q
cctcgagcggctatccataatgt

SEQ ID NO: 119 - DNA, 23 bp, Artificial Sequence
  CCTGAGAACTCGTGTGATCCTCG
cctgagaactcgtgtgatcctcg

SEQ ID NO: 120 - DNA, 23 bp, Artificial Sequence
  mutated target sequence D2014N
cctgagaactcgtgtaatcctcg

SEQ ID NO: 121 - DNA, 23 bp, Artificial Sequence
  mutated target sequence C2013Y, D2014N
cctgagaactcgtataatcctcg

SEQ ID NO: 122 - DNA, 23 bp, Artificial Sequence
  wild type
cctgttgcatacattcctgagaa

SEQ ID NO: 123 - DNA, 23 bp, Artificial Sequence
  mutated target sequence E2010K
cctgttgcatacattcctaagaa

SEQ ID NO: 124 - DNA, 23 bp, Artificial Sequence
  mutated target sequence E2010K
cctgttgcatacattcctaaaaa

SEQ ID NO: 125 - DNA, 23 bp, Artificial Sequence
  wild type
ccgttggacccaccggacagacc

SEQ ID NO: 126 - DNA, 23 bp, Artificial Sequence
  mutated target sequence D2002N
ccgttggacccaccgaacagacc

SEQ ID NO: 127 - DNA, 23 bp, Artificial Sequence
  wild type
cctattattcttacaggctattc

SEQ ID NO: 128 - DNA, 23 bp, Artificial Sequence
  mutated target sequence G1932D
cctattattcttacagactattc

SEQ ID NO: 129 - DNA, 2521 bp, Artificial Sequence
  APOBEC1, partial nCas9 and UGI
cctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggaagacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctc

SEQ ID NO: 130 - DNA, 1835 bp, Artificial Sequence
  pUC57 vector
ccaatgatatcggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 131 - DNA, 2720 bp, Artificial Sequence
  partial nCas9
cctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgt

SEQ ID NO: 132 - DNA, 7059 bp, Artificial Sequence
  pUC57-APOBEC1-nCas9-UGI vector
ccaatgatcctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcatcggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 133 - DNA, 18803 bp, Artificial Sequence
  pZRH-PBE vector
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgtgagaccaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccggtctcggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 134 - DNA, 17605 bp, Artificial Sequence
  pZRH-PBE-R1 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccagtgcttattctagggcatatgttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 135 - DNA, 17605 bp, Artificial Sequence
  pZRH-PBE-R2 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccggtgcatacagcgtcttgaccgttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 136 - DNA, 17605 bp, Artificial Sequence
  pZRH-PBE-R4 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgtctgcactgaacaagcttcttgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 137 - DNA, 17605 bp, Artificial Sequence
  pZRH-PBE-R5 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccacatgcagttgggtggtcccagttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 138 - DNA, 17605 bp, Artificial Sequence
  pZRH-PBE-R6 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccatcttactgtttcagatgaccgttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 139 - DNA, 17605 bp, Artificial Sequence
  pZRH-PBE-R7 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccctgctgaccctggtcagcttggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 140 - DNA, 17605 bp, Artificial Sequence
  pZRH-PBE-R8  construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgttcctcgtgctggacaagtgtgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 141 - DNA, 17605 bp, Artificial Sequence
  pZRH-PBE-R10 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcaagactgcgcaggcattgctgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 142 - DNA, 17605 bp, Artificial Sequence
  pZRH-PBE-R11 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcctcgctaactggagaggcttctgttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 143 - DNA, 17605 bp, Artificial Sequence
  pZRH-PBE-R12 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcgactattgttgagaaccttagggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 144 - DNA, 17605 bp, Artificial Sequence
  pZRH-PBE-R13 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccatggctgcagagctacgaggagttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 145 - DNA, 17605 bp, Artificial Sequence
  pZRH-PBE-R14 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccgcattgagtgctatgctgagagttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 146 - DNA, 17605 bp, Artificial Sequence
  pZRH-PBE-R15 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgtatgctgagaggactgcaaaagggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 147 - DNA, 17605 bp, Artificial Sequence
  pZRH-PBE-R16 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccaggattgcatgagtcggcttggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 148 - DNA, 17605 bp, Artificial Sequence
  pZRH-PBE-R17 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgggagcttatcttgctcgacttgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 149 - DNA, 17605 bp, Artificial Sequence
  pZRH-PBE-R18 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccgcaagggttaattgagatcaagttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 150 - DNA, 17605 bp, Artificial Sequence
  pZRH-PBE-R19 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgtgcttattctagggcatataagggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 151 - DNA, 17605 bp, Artificial Sequence
  pZRH-PBE-R20 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgtttacacttacatttgtgactgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 152 - DNA, 17605 bp, Artificial Sequence
  pZRH-PBE-R21 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgagctcccacatgcagttgggtgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 153 - DNA, 17605 bp, Artificial Sequence
  pZRH-PBE-R22 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgactgtttcagatgaccttgaagggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 154 - DNA, 17605 bp, Artificial Sequence
  pZRH-PBE-R23 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcggcgtttctaatatattgaggtgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 155 - DNA, 17605 bp, Artificial Sequence
  pZRH-PBE-R24 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgtatgttcctgcctacattggtgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 156 - DNA, 17605 bp, Artificial Sequence
  pZRH-PBE-R25 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgacttccagtaacaacaccgttgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 157 - DNA, 17605 bp, Artificial Sequence
  pZRH-PBE-R26 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgaacaacaccgttggacccaccgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 158 - DNA, 17605 bp, Artificial Sequence
  pZRH-PBE-R27 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcggaactcgtgtgatcctcgagcgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 159 - DNA, 17605 bp, Artificial Sequence
  pZRH-PBE-R28 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcggttactggcagagcaaagcttgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 160 - DNA, 17605 bp, Artificial Sequence
  pZRH-PBE-R29 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcaaactatccctgctgaccctgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 161 - DNA, 17605 bp, Artificial Sequence
  pZRH-PBE-R30 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgatggctgcagagctacgaggagggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 162 - DNA, 17605 bp, Artificial Sequence
  pZRH-PBE-R31 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcggactgcaaaaggcaatgttctgggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 163 - DNA, 17605 bp, Artificial Sequence
  pZRH-PBE-R32 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcccagaccgcattgagtgctatggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 164 - DNA, 17605 bp, Artificial Sequence
  pZRH-PBE-R33 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcctttgtctacattcccatggctgttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 165 - DNA, 17605 bp, Artificial Sequence
  pZRH-PBE-R34 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccagtgggtgtgatagctgtggagttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 166 - DNA, 17605 bp, Artificial Sequence
  pZRH-PBE-R35 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccaagggaaatggttaggtggtagttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 167 - DNA, 17605 bp, Artificial Sequence
  pZRH-PBE-R36 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcctcgagcggctatccgtggtgtgttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 168 - DNA, 17605 bp, Artificial Sequence
  pZRH-PBE-R37 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcctgagaactcgtgtgatcctcggttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 169 - DNA, 17605 bp, Artificial Sequence
  pZRH-PBE-R38 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcctgttgcatacattcctgagaagttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 170 - DNA, 17605 bp, Artificial Sequence
  pZRH-PBE-R39 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgccgttggacccaccggacagaccgttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 171 - DNA, 17605 bp, Artificial Sequence
  pZRH-PBE-R40 construct
taaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttagtaattcatccaggtcaccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcgcctattattcttacaggctattcgttttagagctagaaatagcaagttaaaataaggctagtccgttatcaacttgaaaaagtggcaccgagtcggtgcttttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagccctaggatgccgaagaagaagcgcaaggtgtccagcgagacgggcccagtggctgtcgacccaacgctgcgcaggcgcatcgagccgcacgagttcgaggtcttcttcgaccccagggagctgcgcaaggagacgtgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacgtggttcctgtcctggagcccctgcggcgagtgctccagggcgatcaccgagttcctcagccgctacccgcacgtgacgctgttcatctacatcgctaggctctaccaccacgctgaccccaggaacaggcagggcctccgcgacctgatctccagcggcgtgaccatccagatcatgacggagcaggagtccggctactgctggaggaacttcgtcaactactccccaagcaacgaggctcactggccgaggtacccacacctctgggtgcgcctctacgtgctcgagctgtactgcatcatcctcggcctgccgccctgcctcaacatcctgaggcgcaagcagccccagctgaccttcttcacgatcgccctccagagctgccactaccagaggctcccaccacacatcctgtgggcgaccggcctcaagtccggcagcgagacgccaggcacgtccgagagcgctacgccagagctgaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccgaagaagaagcgcaaggtctgagctcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaacagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaa

SEQ ID NO: 172 - DNA, 1785 bp, Oryza sativa
atgcagtcgcttgccctcacctccccctcccttccggcgccggcgaccgcatccggccgccgccgccgccgcctggagcgcatccgcgccaccgcggtgtccgacgagccgaagctgaacaagtacagcgcgcgcatcacggagcccaagtcgcagggggcgtcgcaggcggtgctctacggcgtggggctcaccgacgccgacctccgcaagccgcaggtgggcgtctcctccgtctggtacgagggcaacacctgcaacatgcaccttctccgcctcgccgaggccgtcagggacggcgtccgcgaggccggcatggtggccttccgcttcaacaccgtcggggtcagcgacgccatctccatgggcacccggggcatgtgctacagcctccagtcgcgcgacctcatcgccgacagcatcgagaccgtcatgggcgcgcagcactacgacgccaacatctccattcctggatgcgacaagaacatgccaggaacaataatggcaatggggcggctgaaccgaccaagtatcatgatatatggtggaactattaagcctggtcattttcagggtaattcttatgacatagtatctgctttccagtgctatggagaatttgttaccggatcaatcagtgatgagcaaagaaagaatgtgctccgcaactcatgcccaggagcaggtgcgtgtggtggtatgtacaccgcaaatacaatggcatccgccatcgagaccatgggtatgagccttccgtacagttcttcaacccctgctgaagacccactaaagctagaggaatgccgtcttgctgggaagtatcttttagaattgttaaagatggatttgaagcctaaagacattatcactgagaaatctttgcggaacgcaatggtcattgtcatggcacttggtgggtctactaatgctgttttgcatttaattgctatcgctaggtctgtaggtctgcaattaactcttgatgattttcagaaggtcagtgaccaagttcctttccttgcggaccttaagcctagtggcaaatatgtcatggaggatctgcataagattggtggaacacctgcagtaattcattatcttctggagcaaggtcttcttgatggtgattgtatgaccgtcactgggaaaactctagcggaaaatgctaaaatcttccctcctctgtccgaaggacagcaaataataaggcccctggacaacccaatcaaatcaactggtcatatacaaatactttatggcaatcttgcaccagaaggttctgtagcaaaaattactggcaaagaggggatgtttttctcaggccctgcactagtgtttgagggtgaagaatctatgattacagctatatcagaaaacccagcgaatttcaaggggaaggtagtagtgatacgaggagaaggaccgaaaggtggaccagggatgcctgaaatgctgactccaactagtgcaataatgggtgctggtcttgggaaggagtgtgccctgctgaccgatggcagattttctggaggatcacatggatttgttgtaggccacatttgtcctgaagcacaggagggaggtccaattggtcttgttcaaaacggtgacaaaattaccattgatgttgtgaagagagtaattgatgttgaactgactgaagctgagctggaagaaagacggaggaaatggacgccgccgccacacaaggctgcccgtggagcgctttggaagtacacgaagctcgtgtcccctgcatcaagaggatgcgtcaccgatgagtag

SEQ ID NO: 173 - DNA, 3676 bp, Triticum aestivum
gcggctccgggtagccgttcactttgatcgccagtagtttcttgccccgctgcttttctcgggggtttcttgcacttcttgcggttcgtgtttggtggggcgtcacctcaatcccgcgcggcttcttgctgacgcgtttctcggcttctctgctccgagtccctcctagattccccgcctggttaatgagcggactcctcctcttcttttccccaaatttttaccctgggccagttagaaatttttagtcagagctctcttaaggagattcttggtcaagtacaagtttttggttagcctgggatcttgcctgagaaatgtgtatggggttttttgctgccgtttttgcggccttaatggcatcaatgatctggaagaaatcagtgaacgcgcttgctcaagtttgccccctttttttctctgtagaaacatctttagagaacgactggtttggtatggaatcggtacttggttaagtttggtgcaagattaatgctcgctttacctttgcgttactttgatttcttcgatctgtgagattttaccagtcttggtaaatgtttcaccacctctgattagtcttgatttccagtagtatattttttttgcgtgcttctgtaataatactagtgttgatatcctagtggctgttgactttggttcttggcaagtacagtaaatgttttgattctccaaggctgaatgctgatctttaccttgctctgcagttttgtgtcctgagccatggctgccaagctgactcgcctccacagcctcagggagcgccttggtgccaccttctcctcccaccccaatgagctcattgcactcttctccaggtatgttcaccagggcaaaggcatgctccagcgccaccagctgcttgctgagtttgacgaactgttcgaatccgacaaggagaagtatgcgccctttgaagacatcctccgagctgctcaggaagcaattgtgctgcccccatgggttgcacttgccatcaggcccaggcctggtgtctgggactacattcgggtgaatgttagtgagctcgctgttgaagagctcactgtttctgagtacttggcattcaaggaacagcttgtcgatgagcatgccagcagcaagtttgtgcttgagcttgattttgagcctttcaatgcctccttcccgcgcccttccatgtccaagtccatcggaaacggggtgcagttccttaaccgtcacctgtcttccaagttgttccaggacaaggagagcctctaccctctgctcaacttcctgaaagcccataactacaagggcacgacaatgatgttgaacgacagaattcagagccttcgcggtctccagtcagcccttaggaaggcagaagagtatctagtcagcattcctgaagacactcccagctctgaattcaaccacaggttccaagagcttggcttggagaagggttggggtgacaccgcaaagcgtgtacacgacaccatccatttgcttctggaccttcttgaggcccctgatccggccagcttggagaagttccttggaaccattccaatgatgttcaatgttgtcatcctgtctccccatggatactttgctcaatccaatgtgttgggataccctgataccggtggccaggttgtgtacatcttggatcaagtccgtgctttggagaatgagatgcttctgaggattaagcagcaaggccttgatataactcccaagatcctcattgtaaccaggttgttgcctgatgctgttggaaccacatgtggccagcggctggagaaggtcattggaactgagcacactgacattctccgtgttccattcagaactgagaatgggatccttcgtaagtggatctcgcgttttgatgtctggccatacctggagacatacaccgaggatgttgcaaacgaactcatgagagaaatgcagaccaagcctgatttgatcattggcaactacagtgatggtaaccttgtggccactctgcttgcccataaattgggagttacccagtgcaccattgcccatgccttggagaaaaccaagtaccccaactcagacatctacttggacaaattcgacagccagtatcacttttcatgccagttcacagctgacctgattgccatgaaccacactgatttcatcatcaccagcacattccaggaaattgccggaagcaaggatagcgtgggccaatacgagtctcacattgctttcaccctccctgatctgtaccgggttgtccatgggattgacgtgtttgatcctaagttcaacatcgtctctcctggagcagacatgactgtctacttcccatacactgagactgacaagaggctcaccgccttccactctgaaattgaggagctcctgtacagcgatgttgagaacgatgaacacaaatttgtgttgaaggacaggaacaagccaatcatcttttcaatggctcgtcttgaccgtgtgaagaacatgactggcttggttgagatgtacggcaagaatgcacatctgaaggatttggcgaaccttgtgattgttgctggcgaccatggcaaggagtccaaggatagggaggagcaggctgagttcaagaggatgtacagtctcattgaggagtacaagctgaagggccatatccgttggatctctgctcagatgaaccgtgttcgcaatggtgagctgtaccgctacatctgtgacaccaagggagcatttgtgcagcctgcattctatgaagcttttggccttactgtcattgaggccatgacatgtggtctgccgacaattgcgacatgccacggtggccctgctgaaatcattgtgaatggggtgtctggtgtgcacattgatccttaccacagtgacaaggccgcagatatcttggtcaacttctttgagaagtgcagcgaggatccaagctactgggacaaaatgtctgaaggaggcctgaagagaatttatgagaagtacacctggaagctgtactcagagaggctgatgaccctgaccggtgtgtatggattctggaagtacgtgagcaacctagagaggcgtgagactcgccgttaccttgagatgttctacgccctgaagtaccgcagcctggctgctgcagttccattggcggttgacggcgagaactccgacaactagcccggtgcaatggggcatgaagaggcgcattcagcgggagggtgaagtgtcggctgcgttatgatttgtctgccgtagttttcatttggtctggtcgtggagtgtgttaatttgttgtctcggcacatttgtgaggtcctgggcagtgctcgctggttcatgccagccgcatttgttgcctggaataaacgcctgcccatggtgttccatctttcatcagagttcaatgcaatgtttcgttgtctgtctcatttctctgtctttcaaaattatttgatcaccccttttgtcatgaatgaacctggtgtgtgtgtggttttggtcaaagcttcactgatgtgtgctgcactgtggagtttttctgaagaatagtgccggtcttggcaaggacaaaaccaaatgccaacaacctatgcactgtaacattggttatgtgatcaaagttctccggaaactaaatactactttgtagtgtcaaaaacgcttttatattatgggatggagg

SEQ ID NO: 174 - DNA, 3055 bp, Solanum lycopersicum
tatatcaaaaaatatcgggcagttttgtagttttaaacatattatatacaatttaaatttttaaaaattgctaaaaatagaagaaataaagattatttttatgaaagtttttttttaaaagattaatcagattgtgagtttttctttttttgacttattgatgtgatgtttatattagagaagccagcaatgcaagtagctgcaaaagggtactaatatatatatatatatatatatatatagcatcaatcaaccatagatcttgatctgatgctaataattaattttattattattttttatcgatattcatattgagatttgaaaaaataatctttcatatatgttcattcaatgacggagaccaaatttaaatcgagtggtgtcaaaattatacaacgtaatcaattgtttaaaaatgagaagaagaaaaaaacactaaagttaaaacttgagctaagatcgaaaaaccgatcattaagagtttttacaactcgttatcttgtgtcacgagatgtcaatattaatatctatcgaaaaataatcaaaatttgatttataattttccgataaacatatattgttggacacgtcatagacaacatatgttatcaataaaagatcggataaataaattaaaacgaaagaaataaagaaaattaatcatatctaaagtaatgattacactttgtttaagatattgtcagtaatatatatttattagtacaacttcaaatgtcaaaaatttatcctcaaattttcctattgggttgggcaggtgtccttttgcatgaaataatccctactaatatttacttgtgataagatataggtgcagttattttcagataataagccgtcactctgtcttgttactgcagtaaaaataataataactattttcttcgttttaatttgtctgatattattcgatcaaatttaaagataagttttataataaggttgaatatatagtcagtagatcctacttataaacatacaaatagagtttacacacatcaactttctccagatcctacttataaaattatactgaatatatcgttatcggttatcgatttgacacaaattttaaacattgaaaaggtgacaatgaaagagatccatagtacagtacttggtgggaatctaattagcataactaaaactgagagttgtatgggttttatatacagctactactattatatgatcactacgtcacaatatcttaattatcattggtttatagtactttcattatagaatcactaagtacagtttgatgccaaatataatcctttttctaattttaattatttttttttatacaatattgttttctatagtgtctaatttaaccatttaatatttgaaattcaatatcctacaacataatttggtgtttcgtagctagtcttaccagtattctcatagtttcatgtgtttcgtttttctgttacttacatgttattttttgtgtttcgattatcttgtattatgttgatatataaaactaattctgactttagctaataagtaactcgaacgaaaaaacaatctatctaaccccataaaggcaggggataaggtctctcgccctcctcaaactctacttgaaaaattacactgatgtattgtcgttgttgttattgttaactcaaactaaacacaagataaatttaatctcattctttcttaaccaaagcctcttaactattttctttgagcaaagtaaaattgaaagaatcaaataaataactgagatgagctcatctttatgtattgcctcagcatgtagaggatttcagaactgcactgtcatatcataaaaagtatacttatgatatacaacaatggctgcatggctcatcattttcttttgttctataaattggcttttactatcttcacttcttatgcactcaactaacactgatccattttgtttcattacacacttagatcaagaacttgctttttcatttgcttcttgaaaaatgtctttgatcaatgctaaatatttcaatctctttgtcttgctgatctgttttttagtaattcaagaatctcatggtctgtctctaaaggaagttgctcctgtgaaactcctaaacagaaaggtttttaacttttcatcttattctcatactatcttttactattgtctaattcatttatactatctattcattcgtgagtctttactgccctgttcttttgttactttccttattttgatcatccacgaggttgtagaaagagagaaagggggtggggtggctatctagaggagttgtttcggttgtatgtcacgatgggcaatggtacaagtgaatcatcgcttagatttccatgactaagtactaatcctttaaaactatatgtgaatgcaggttttagaaaggcagtgggctgcatttgggaaggtatactacaagcatgcagagaagattaatgagaagtttgctgattgggagctaagaggagttccagctggtcctgatccattgcatcacaatggtgctagtcctaagaaacctaagactccataatcatgcaatattagtattgttttagctctatgttcaagtttttagtaaagggtagtatatggtttcatctttctgtttttgttgtttttggcccaatagaaaaggaaaaaacaaaaagaaaacgaaaatgtaagtatgggcttaggctttaggctagccaagttggaatattaggatttcatgtctccctgatatgtatatagctttgatgcaaagttttcgtttttataactagtactaagaaaactcaagaatgaacacaagtttttgctgtactagcaatgtcatcgatccaacgaacgtttttgagaagagacaaagtcagttgaggaacaacaacaacaacaacaaacacacattgtagtccaacaagtggggttgtggagtttgggaagggtagtatgtatgcaaacttatccctaccttgtgaatattgagagattgttaacgaatcagttgaggaagaagagacaaaaaaaactcgagtccaagacacatgt

SEQ ID NO: 175 - DNA, 6381 bp, Artificial Sequence
  STEME-1
atggaggccagcccggctagcggcccaaggcatctcatggacccgcacatcttcaccagcaacttcaacaacggcatcggcaggcacaagacctacttgtgctacgaggtggagaggctcgacaacggaacctccgtgaagatggaccaacacagggggttcctccacaaccaagccaagaacctcctctgcggcttctacggcaggcacgccgagttgaggttcctcgacttggtgccatccctccaactcgatccagcccaaatctaccgcgtgacctggttcatctcctggtccccatgcttctcctggggttgcgccggcgaggttcgggctttcctccaagaaaacacccacgtccgcctccgcattttcgccgccaggatctatgattacgaccctctctacaaggaggccctccagatgctgcgggacgccggtgctcaggtgagtatcatgacctacgacgagttcaagcactgctgggacaccttcgttgaccaccagggctgcccattccaaccatgggacggtctggatgaacacagccaagccttgtccggcaggctccgggccatcctccaaaaccaggggaactccgggagcgagacgccaggcacctccgagtcggccaccccagaatcttccggcggatcttctggaggatctagcggctccgagacaccaggaacatccgaatccgctacaccagagtcttctggaggatctagcggaggatcttccgaggtggagttctctcacgagtattggatgaggcacgctcttacacttgctaagagagcttgggacgaaagagaagtgccagttggcgccgttcttgtgcataataatagggtgatcggcgagggttggaatagaccaattggaaggcatgatccaacagctcacgcagagattatggctctcagacaaggcggcctcgttatgcagaactacaggctcattgacgctacactctacgtgacactcgaaccttgcgttatgtgcgccggagctatgattcattctaggattggcagggtcgtgtttggagctagggacgctaaaacaggagccgccggatctcttatggacgtgttgcatcatccaggcatgaaccatagggtggagattacagagggcattcttgcagacgagtgcgctgctcttctttccgatttcttcaggatgagaaggcaggagattaaggcccagaagaaggctcagtcttctacagatagcggaggatcttccggaggatctagcggctccgagacaccaggaacatccgaaagcgctacaccagaatctagcggaggctcttccggaggatcttctgaagtggagttctcccacgagtattggatgaggcacgctcttacacttgctaaaagggctagggacgaaagggaagttccagttggagctgttctcgtgctcaataacagggtgattggcgagggttggaatagagccattggactccatgatccaacagctcacgcagagattatggctcttagacaaggcggcctcgttatgcagaattacagactcatcgacgccacactctacgttaccttcgaaccttgcgttatgtgcgccggagctatgatccattctaggattggcagggtcgtgttcggcgttagaaacgctaagacaggagctgcaggctctcttatggacgttcttcattacccaggcatgaatcatagagtggagatcacagaaggcattcttgcagacgagtgcgcagctctcctttgctatttcttcaggatgccgaggcaagttttcaacgctcagaagaaggcccagtcttctacagattccggcggatcttctggaggatctagcggctccgagacaccaggaacatccgaatccgctacaccagagtcttctggaggatctagcggaggatctgacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaaggaattctccggcggcagcaccaacctgtccgacatcatcgagaaggagacgggcaagcaactcgtgatccaggagagcatcctcatgctgccagaggaggtggaggaggtcatcggcaacaagccagagtccgacatcctggtgcacaccgcctacgacgagtccaccgacgagaacgtcatgctcctgaccagcgacgccccagagtacaagccatgggccctcgtcatccaggacagcaacggggagaacaagatcaagatgctgtcgggggggagcccaaagaagaagcggaaggtgtag

SEQ ID NO: 176 - protein, 2126 aa, Artificial Sequence
  STEME-1
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSGSETPGTSESATPESSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKEFSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 177 - DNA, 6291 bp, Artificial Sequence
  STEME-2
atgtccgaggtggagttctctcacgagtattggatgaggcacgctcttacacttgctaagagagcttgggacgaaagagaagtgccagttggcgccgttcttgtgcataataatagggtgatcggcgagggttggaatagaccaattggaaggcatgatccaacagctcacgcagagattatggctctcagacaaggcggcctcgttatgcagaactacaggctcattgacgctacactctacgtgacactcgaaccttgcgttatgtgcgccggagctatgattcattctaggattggcagggtcgtgtttggagctagggacgctaaaacaggagccgccggatctcttatggacgtgttgcatcatccaggcatgaaccatagggtggagattacagagggcattcttgcagacgagtgcgctgctcttctttccgatttcttcaggatgagaaggcaggagattaaggcccagaagaaggctcagtcttctacagatagcggaggatcttccggaggatctagcggctccgagacaccaggaacatccgaaagcgctacaccagaatctagcggaggctcttccggaggatcttctgaagtggagttctcccacgagtattggatgaggcacgctcttacacttgctaaaagggctagggacgaaagggaagttccagttggagctgttctcgtgctcaataacagggtgattggcgagggttggaatagagccattggactccatgatccaacagctcacgcagagattatggctcttagacaaggcggcctcgttatgcagaattacagactcatcgacgccacactctacgttaccttcgaaccttgcgttatgtgcgccggagctatgatccattctaggattggcagggtcgtgttcggcgttagaaacgctaagacaggagctgcaggctctcttatggacgttcttcattacccaggcatgaatcatagagtggagatcacagaaggcattcttgcagacgagtgcgcagctctcctttgctatttcttcaggatgccgaggcaagttttcaacgctcagaagaaggcccagtcttctacagattccggcggatcttctggaggatctagcggctccgagacaccaggaacatccgaatccgctacaccagagtcttctggaggatctagcggaggatctgaggccagcccggctagcggcccaaggcatctcatggacccgcacatcttcaccagcaacttcaacaacggcatcggcaggcacaagacctacttgtgctacgaggtggagaggctcgacaacggaacctccgtgaagatggaccaacacagggggttcctccacaaccaagccaagaacctcctctgcggcttctacggcaggcacgccgagttgaggttcctcgacttggtgccatccctccaactcgatccagcccaaatctaccgcgtgacctggttcatctcctggtccccatgcttctcctggggttgcgccggcgaggttcgggctttcctccaagaaaacacccacgtccgcctccgcattttcgccgccaggatctatgattacgaccctctctacaaggaggccctccagatgctgcgggacgccggtgctcaggtgagtatcatgacctacgacgagttcaagcactgctgggacaccttcgttgaccaccagggctgcccattccaaccatgggacggtctggatgaacacagccaagccttgtccggcaggctccgggccatcctccaaaaccaggggaactccgggagcgagacgccaggcacctccgagtcggccaccccagaatctcttaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaaggaattctccggcggcagcaccaacctgtccgacatcatcgagaaggagacgggcaagcaactcgtgatccaggagagcatcctcatgctgccagaggaggtggaggaggtcatcggcaacaagccagagtccgacatcctggtgcacaccgcctacgacgagtccaccgacgagaacgtcatgctcctgaccagcgacgccccagagtacaagccatgggccctcgtcatccaggacagcaacggggagaacaagatcaagatgctgtcgggggggagcccaaagaagaagcggaaggtgtag

SEQ ID NO: 178 - protein, 2096 aa, Artificial Sequence
  STEME-2
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSGSETPGTSESATPESLKDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKEFSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 179 - DNA, 6759 bp, Artificial Sequence
  STEME-3
atggaggccagcccggctagcggcccaaggcatctcatggacccgcacatcttcaccagcaacttcaacaacggcatcggcaggcacaagacctacttgtgctacgaggtggagaggctcgacaacggaacctccgtgaagatggaccaacacagggggttcctccacaaccaagccaagaacctcctctgcggcttctacggcaggcacgccgagttgaggttcctcgacttggtgccatccctccaactcgatccagcccaaatctaccgcgtgacctggttcatctcctggtccccatgcttctcctggggttgcgccggcgaggttcgggctttcctccaagaaaacacccacgtccgcctccgcattttcgccgccaggatctatgattacgaccctctctacaaggaggccctccagatgctgcgggacgccggtgctcaggtgagtatcatgacctacgacgagttcaagcactgctgggacaccttcgttgaccaccagggctgcccattccaaccatgggacggtctggatgaacacagccaagccttgtccggcaggctccgggccatcctccaaaaccaggggaactccgggagcgagacgccaggcacctccgagtcggccaccccagaatcttccggcggatcttctggaggatctagcggctccgagacaccaggaacatccgaatccgctacaccagagtcttctggaggatctagcggaggatcttccgaggtggagttctctcacgagtattggatgaggcacgctcttacacttgctaagagagcttgggacgaaagagaagtgccagttggcgccgttcttgtgcataataatagggtgatcggcgagggttggaatagaccaattggaaggcatgatccaacagctcacgcagagattatggctctcagacaaggcggcctcgttatgcagaactacaggctcattgacgctacactctacgtgacactcgaaccttgcgttatgtgcgccggagctatgattcattctaggattggcagggtcgtgtttggagctagggacgctaaaacaggagccgccggatctcttatggacgtgttgcatcatccaggcatgaaccatagggtggagattacagagggcattcttgcagacgagtgcgctgctcttctttccgatttcttcaggatgagaaggcaggagattaaggcccagaagaaggctcagtcttctacagatagcggaggatcttccggaggatctagcggctccgagacaccaggaacatccgaaagcgctacaccagaatctagcggaggctcttccggaggatcttctgaagtggagttctcccacgagtattggatgaggcacgctcttacacttgctaaaagggctagggacgaaagggaagttccagttggagctgttctcgtgctcaataacagggtgattggcgagggttggaatagagccattggactccatgatccaacagctcacgcagagattatggctcttagacaaggcggcctcgttatgcagaattacagactcatcgacgccacactctacgttaccttcgaaccttgcgttatgtgcgccggagctatgatccattctaggattggcagggtcgtgttcggcgttagaaacgctaagacaggagctgcaggctctcttatggacgttcttcattacccaggcatgaatcatagagtggagatcacagaaggcattcttgcagacgagtgcgcagctctcctttgctatttcttcaggatgccgaggcaagttttcaacgctcagaagaaggcccagtcttctacagattccggcggatcttctggaggatctagcggctccgagacaccaggaacatccgaatccgctacaccagagtcttctggaggatctagcggaggatctgacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaaggaattcgagggcagaggaagtcttctaacatgcggtgacgtggaggagaatcccggccctaccaacctgtccgacatcatcgagaaggagacgggcaagcaactcgtgatccaggagagcatcctcatgctgccagaggaggtggaggaggtcatcggcaacaagccagagtccgacatcctggtgcacaccgcctacgacgagtccaccgacgagaacgtcatgctcctgaccagcgacgccccagagtacaagccatgggccctcgtcatccaggacagcaacggggagaacaagatcaagatgctgtcgggggggagcccaaagaagaagcggaaggtggagggcagaggaagtcttctaacatgcggtgacgtggaggagaatcccggccctaccaacctgtccgacatcatcgagaaggagacgggcaagcaactcgtgatccaggagagcatcctcatgctgccagaggaggtggaggaggtcatcggcaacaagccagagtccgacatcctggtgcacaccgcctacgacgagtccaccgacgagaacgtcatgctcctgaccagcgacgccccagagtacaagccatgggccctcgtcatccaggacagcaacggggagaacaagatcaagatgctgtcgggggggagcccaaagaagaagcggaaggtgtag

SEQ ID NO: 180 - protein, 2252 aa, Artificial Sequence
  STEME-3
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSGSETPGTSESATPESSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKEFEGRGSLLTCGDVEENPGPTNLSDIIEKETGKQLVIQESILMLPEEVEEVIGNKPESDILVHTAYDESTDENVMLLTSDAPEYKPWALVIQDSNGENKIKMLSGGSPKKKRKVEGRGSLLTCGDVEENPGPTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 181 - DNA, 6663 bp, Artificial Sequence
  STEME-4
atgtccgaggtggagttctctcacgagtattggatgaggcacgctcttacacttgctaagagagcttgggacgaaagagaagtgccagttggcgccgttcttgtgcataataatagggtgatcggcgagggttggaatagaccaattggaaggcatgatccaacagctcacgcagagattatggctctcagacaaggcggcctcgttatgcagaactacaggctcattgacgctacactctacgtgacactcgaaccttgcgttatgtgcgccggagctatgattcattctaggattggcagggtcgtgtttggagctagggacgctaaaacaggagccgccggatctcttatggacgtgttgcatcatccaggcatgaaccatagggtggagattacagagggcattcttgcagacgagtgcgctgctcttctttccgatttcttcaggatgagaaggcaggagattaaggcccagaagaaggctcagtcttctacagatagcggaggatcttccggaggatctagcggctccgagacaccaggaacatccgaaagcgctacaccagaatctagcggaggctcttccggaggatcttctgaagtggagttctcccacgagtattggatgaggcacgctcttacacttgctaaaagggctagggacgaaagggaagttccagttggagctgttctcgtgctcaataacagggtgattggcgagggttggaatagagccattggactccatgatccaacagctcacgcagagattatggctcttagacaaggcggcctcgttatgcagaattacagactcatcgacgccacactctacgttaccttcgaaccttgcgttatgtgcgccggagctatgatccattctaggattggcagggtcgtgttcggcgttagaaacgctaagacaggagctgcaggctctcttatggacgttcttcattacccaggcatgaatcatagagtggagatcacagaaggcattcttgcagacgagtgcgcagctctcctttgctatttcttcaggatgccgaggcaagttttcaacgctcagaagaaggcccagtcttctacagattccggcggatcttctggaggatctagcggctccgagacaccaggaacatccgaatccgctacaccagagtcttctggaggatctagcggaggatctgaggccagcccggctagcggcccaaggcatctcatggacccgcacatcttcaccagcaacttcaacaacggcatcggcaggcacaagacctacttgtgctacgaggtggagaggctcgacaacggaacctccgtgaagatggaccaacacagggggttcctccacaaccaagccaagaacctcctctgcggcttctacggcaggcacgccgagttgaggttcctcgacttggtgccatccctccaactcgatccagcccaaatctaccgcgtgacctggttcatctcctggtccccatgcttctcctggggttgcgccggcgaggttcgggctttcctccaagaaaacacccacgtccgcctccgcattttcgccgccaggatctatgattacgaccctctctacaaggaggccctccagatgctgcgggacgccggtgctcaggtgagtatcatgacctacgacgagttcaagcactgctgggacaccttcgttgaccaccagggctgcccattccaaccatgggacggtctggatgaacacagccaagccttgtccggcaggctccgggccatcctccaaaaccaggggaactccgggagcgagacgccaggcacctccgagtcggccaccccagaatctgacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattctgcctaagcggaacagcgacaagctcatcgcccgcaagaaggactgggatccgaagaagtacggcgggttcgacagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctggcgagctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctgctgctttcaagtacttcgacacaactatcgatcgcaagaggtacacaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaaggaattcgagggcagaggaagtcttctaacatgcggtgacgtggaggagaatcccggccctaccaacctgtccgacatcatcgagaaggagacgggcaagcaactcgtgatccaggagagcatcctcatgctgccagaggaggtggaggaggtcatcggcaacaagccagagtccgacatcctggtgcacaccgcctacgacgagtccaccgacgagaacgtcatgctcctgaccagcgacgccccagagtacaagccatgggccctcgtcatccaggacagcaacggggagaacaagatcaagatgctgtcgggggggagcccaaagaagaagcggaaggtggagggcagaggaagtcttctaacatgcggtgacgtggaggagaatcccggccctaccaacctgtccgacatcatcgagaaggagacgggcaagcaactcgtgatccaggagagcatcctcatgctgccagaggaggtggaggaggtcatcggcaacaagccagagtccgacatcctggtgcacaccgcctacgacgagtccaccgacgagaacgtcatgctcctgaccagcgacgccccagagtacaagccatgggccctcgtcatccaggacagcaacggggagaacaagatcaagatgctgtcgggggggagcccaaagaagaagcggaaggtgtag

SEQ ID NO: 182 - protein, 2220 aa, Artificial Sequence
  STEME-4
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKEFEGRGSLLTCGDVEENPGPTNLSDIIEKETGKQLVIQESILMLPEEVEEVIGNKPESDILVHTAYDESTDENVMLLTSDAPEYKPWALVIQDSNGENKIKMLSGGSPKKKRKVEGRGSLLTCGDVEENPGPTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 183 - DNA, 6384 bp, Artificial Sequence
  STEME-NG
atggaggccagcccggctagcggcccaaggcatctcatggacccgcacatcttcaccagcaacttcaacaacggcatcggcaggcacaagacctacttgtgctacgaggtggagaggctcgacaacggaacctccgtgaagatggaccaacacagggggttcctccacaaccaagccaagaacctcctctgcggcttctacggcaggcacgccgagttgaggttcctcgacttggtgccatccctccaactcgatccagcccaaatctaccgcgtgacctggttcatctcctggtccccatgcttctcctggggttgcgccggcgaggttcgggctttcctccaagaaaacacccacgtccgcctccgcattttcgccgccaggatctatgattacgaccctctctacaaggaggccctccagatgctgcgggacgccggtgctcaggtgagtatcatgacctacgacgagttcaagcactgctgggacaccttcgttgaccaccagggctgcccattccaaccatgggacggtctggatgaacacagccaagccttgtccggcaggctccgggccatcctccaaaaccaggggaactccgggagcgagacgccaggcacctccgagtcggccaccccagaatcttccggcggatcttctggaggatctagcggctccgagacaccaggaacatccgaatccgctacaccagagtcttctggaggatctagcggaggatcttccgaggtggagttctctcacgagtattggatgaggcacgctcttacacttgctaagagagcttgggacgaaagagaagtgccagttggcgccgttcttgtgcataataatagggtgatcggcgagggttggaatagaccaattggaaggcatgatccaacagctcacgcagagattatggctctcagacaaggcggcctcgttatgcagaactacaggctcattgacgctacactctacgtgacactcgaaccttgcgttatgtgcgccggagctatgattcattctaggattggcagggtcgtgtttggagctagggacgctaaaacaggagccgccggatctcttatggacgtgttgcatcatccaggcatgaaccatagggtggagattacagagggcattcttgcagacgagtgcgctgctcttctttccgatttcttcaggatgagaaggcaggagattaaggcccagaagaaggctcagtcttctacagatagcggaggatcttccggaggatctagcggctccgagacaccaggaacatccgaaagcgctacaccagaatctagcggaggctcttccggaggatcttctgaagtggagttctcccacgagtattggatgaggcacgctcttacacttgctaaaagggctagggacgaaagggaagttccagttggagctgttctcgtgctcaataacagggtgattggcgagggttggaatagagccattggactccatgatccaacagctcacgcagagattatggctcttagacaaggcggcctcgttatgcagaattacagactcatcgacgccacactctacgttaccttcgaaccttgcgttatgtgcgccggagctatgatccattctaggattggcagggtcgtgttcggcgttagaaacgctaagacaggagctgcaggctctcttatggacgttcttcattacccaggcatgaatcatagagtggagatcacagaaggcattcttgcagacgagtgcgcagctctcctttgctatttcttcaggatgccgaggcaagttttcaacgctcagaagaaggcccagtcttctacagattccggcggatcttctggaggatctagcggctccgagacaccaggaacatccgaatccgctacaccagagtcttctggaggatctagcggaggatctgacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattcggcctaagcggaacagcgacaagctcatcgcccgcaagaaggactgggatccgaagaagtacggcgggttcgtcagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctcgcttcctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctcgtgctttcaagtacttcgacacaactatcgatcgcaaggtatacagaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagacccgcgactccggcggcagcacgaacctctccgacatcatcgagaaggagacgggcaagcagctcgtgatccaggagagcatcctcatgctgccggaggaggtggaggaggtcatcggcaacaagcccgagtccgacatcctcgtgcacaccgcctacgacgagtccacggacgagaacgtcatgctcctgacgagcgacgctccagagtacaagccatgggctctcgtgatccaggacagcaacggcgagaacaagatcaagatgctgtccggcggctccccaaagaagaagcggaaggtgtag

SEQ ID NO: 184 - protein, 2127 aa, Artificial Sequence
  STEME-NG
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSGSETPGTSESATPESSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGDKRPAATKKAGQAKKKKTRDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 185 - DNA, 5103 bp, Artificial Sequence
  A3A-PBE-NG
atggaggccagcccggctagcggcccaaggcatctcatggacccgcacatcttcaccagcaacttcaacaacggcatcggcaggcacaagacctacttgtgctacgaggtggagaggctcgacaacggaacctccgtgaagatggaccaacacagggggttcctccacaaccaagccaagaacctcctctgcggcttctacggcaggcacgccgagttgaggttcctcgacttggtgccatccctccaactcgatccagcccaaatctaccgcgtgacctggttcatctcctggtccccatgcttctcctggggttgcgccggcgaggttcgggctttcctccaagaaaacacccacgtccgcctccgcattttcgccgccaggatctatgattacgaccctctctacaaggaggccctccagatgctgcgggacgccggtgctcaggtgagtatcatgacctacgacgagttcaagcactgctgggacaccttcgttgaccaccagggctgcccattccaaccatgggacggtctggatgaacacagccaagccttgtccggcaggctccgggccatcctccaaaaccaggggaactccgggagcgagacgccaggcacctccgagtcggccaccccagaatctcttaaggacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattcggcctaagcggaacagcgacaagctcatcgcccgcaagaaggactgggatccgaagaagtacggcgggttcgtcagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctcgcttcctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctcgtgctttcaagtacttcgacacaactatcgatcgcaaggtatacagaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaaggaattctccggcggcagcaccaacctgtccgacatcatcgagaaggagacgggcaagcaactcgtgatccaggagagcatcctcatgctgccagaggaggtggaggaggtcatcggcaacaagccagagtccgacatcctggtgcacaccgcctacgacgagtccaccgacgagaacgtcatgctcctgaccagcgacgccccagagtacaagccatgggccctcgtcatccaggacagcaacggggagaacaagatcaagatgctgtcgggggggagcccaaagaagaagcggaaggtgtag

SEQ ID NO: 186 - protein, 1700 aa, Artificial Sequence
  A3A-PBE-NG
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSGSETPGTSESATPESLKDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGDKRPAATKKAGQAKKKKEFSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 187 - DNA, 5394 bp, Artificial Sequence
  PABE7-NG
atgtccgaggtggagttctctcacgagtattggatgaggcacgctcttacacttgctaagagagcttgggacgaaagagaagtgccagttggcgccgttcttgtgcataataatagggtgatcggcgagggttggaatagaccaattggaaggcatgatccaacagctcacgcagagattatggctctcagacaaggcggcctcgttatgcagaactacaggctcattgacgctacactctacgtgacactcgaaccttgcgttatgtgcgccggagctatgattcattctaggattggcagggtcgtgtttggagctagggacgctaaaacaggagccgccggatctcttatggacgtgttgcatcatccaggcatgaaccatagggtggagattacagagggcattcttgcagacgagtgcgctgctcttctttccgatttcttcaggatgagaaggcaggagattaaggcccagaagaaggctcagtcttctacagatagcggaggatcttccggaggatctagcggctccgagacaccaggaacatccgaaagcgctacaccagaatctagcggaggctcttccggaggatcttctgaagtggagttctcccacgagtattggatgaggcacgctcttacacttgctaaaagggctagggacgaaagggaagttccagttggagctgttctcgtgctcaataacagggtgattggcgagggttggaatagagccattggactccatgatccaacagctcacgcagagattatggctcttagacaaggcggcctcgttatgcagaattacagactcatcgacgccacactctacgttaccttcgaaccttgcgttatgtgcgccggagctatgatccattctaggattggcagggtcgtgttcggcgttagaaacgctaagacaggagctgcaggctctcttatggacgttcttcattacccaggcatgaatcatagagtggagatcacagaaggcattcttgcagacgagtgcgcagctctcctttgctatttcttcaggatgccgaggcaagttttcaacgctcagaagaaggcccagtcttctacagattccggcggatcttctggaggatctagcggctccgagacaccaggaacatccgaatccgctacaccagagtcttctggaggatctagcggaggatctgacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattcggcctaagcggaacagcgacaagctcatcgcccgcaagaaggactgggatccgaagaagtacggcgggttcgtcagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctcgcttcctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctcgtgctttcaagtacttcgacacaactatcgatcgcaaggtatacagaagcactaaggaggtcctggacgcgaccctcatccaccagtcgattaccggcctctacgagacgcgcatcgacctgtctcagctcgggggcgactccggcggcagcccaaagaagaagcggaaggtgtctggaggttctcctaagaaaaagagaaaagtgtccggcggctccccgaagaagaagcgcaaggtgtag

SEQ ID NO: 188 - protein, 1797 aa, Artificial Sequence
  PABE7-NG
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGDSGGSPKKKRKVSGGSPKKKRKVSGGSPKKKRKV

SEQ ID NO: 189 - DNA, 4203 bp, Artificial Sequence
  pCas9-NG
atggctccgaagaagaagaggaaggttggcatccacggggtgccagctgctgacaagaagtactcgatcggcctcgccattgggactaactctgttggctgggccgtgatcaccgacgagtacaaggtgccctcaaagaagttcaaggtcctgggcaacaccgatcggcattccatcaagaagaatctcattggcgctctcctgttcgacagcggcgagacggctgaggctacgcggctcaagcgcaccgcccgcaggcggtacacgcgcaggaagaatcgcatctgctacctgcaggagattttctccaacgagatggcgaaggttgacgattctttcttccacaggctggaggagtcattcctcgtggaggaggataagaagcacgagcggcatccaatcttcggcaacattgtcgacgaggttgcctaccacgagaagtaccctacgatctaccatctgcggaagaagctcgtggactccacagataaggcggacctccgcctgatctacctcgctctggcccacatgattaagttcaggggccatttcctgatcgagggggatctcaacccggacaatagcgatgttgacaagctgttcatccagctcgtgcagacgtacaaccagctcttcgaggagaaccccattaatgcgtcaggcgtcgacgcgaaggctatcctgtccgctaggctctcgaagtctcggcgcctcgagaacctgatcgcccagctgccgggcgagaagaagaacggcctgttcgggaatctcattgcgctcagcctggggctcacgcccaacttcaagtcgaatttcgatctcgctgaggacgccaagctgcagctctccaaggacacatacgacgatgacctggataacctcctggcccagatcggcgatcagtacgcggacctgttcctcgctgccaagaatctgtcggacgccatcctcctgtctgatattctcagggtgaacaccgagattacgaaggctccgctctcagcctccatgatcaagcgctacgacgagcaccatcaggatctgaccctcctgaaggcgctggtcaggcagcagctccccgagaagtacaaggagatcttcttcgatcagtcgaagaacggctacgctgggtacattgacggcggggcctctcaggaggagttctacaagttcatcaagccgattctggagaagatggacggcacggaggagctgctggtgaagctcaatcgcgaggacctcctgaggaagcagcggacattcgataacggcagcatcccacaccagattcatctcggggagctgcacgctatcctgaggaggcaggaggacttctaccctttcctcaaggataaccgcgagaagatcgagaagattctgactttcaggatcccgtactacgtcggcccactcgctaggggcaactcccgcttcgcttggatgacccgcaagtcagaggagacgatcacgccgtggaacttcgaggaggtggtcgacaagggcgctagcgctcagtcgttcatcgagaggatgacgaatttcgacaagaacctgccaaatgagaaggtgctccctaagcactcgctcctgtacgagtacttcacagtctacaacgagctgactaaggtgaagtatgtgaccgagggcatgaggaagccggctttcctgtctggggagcagaagaaggccatcgtggacctcctgttcaagaccaaccggaaggtcacggttaagcagctcaaggaggactacttcaagaagattgagtgcttcgattcggtcgagatctctggcgttgaggaccgcttcaacgcctccctggggacctaccacgatctcctgaagatcattaaggataaggacttcctggacaacgaggagaatgaggatatcctcgaggacattgtgctgacactcactctgttcgaggaccgggagatgatcgaggagcgcctgaagacttacgcccatctcttcgatgacaaggtcatgaagcagctcaagaggaggaggtacaccggctgggggaggctgagcaggaagctcatcaacggcattcgggacaagcagtccgggaagacgatcctcgacttcctgaagagcgatggcttcgcgaaccgcaatttcatgcagctgattcacgatgacagcctcacattcaaggaggatatccagaaggctcaggtgagcggccagggggactcgctgcacgagcatatcgcgaacctcgctggctcgccagctatcaagaaggggattctgcagaccgtgaaggttgtggacgagctggtgaaggtcatgggcaggcacaagcctgagaacatcgtcattgagatggcccgggagaatcagaccacgcagaagggccagaagaactcacgcgagaggatgaagaggatcgaggagggcattaaggagctggggtcccagatcctcaaggagcacccggtggagaacacgcagctgcagaatgagaagctctacctgtactacctccagaatggccgcgatatgtatgtggaccaggagctggatattaacaggctcagcgattacgacgtcgatcatatcgttccacagtcattcctgaaggatgactccattgacaacaaggtcctcaccaggtcggacaagaaccggggcaagtctgataatgttccttcagaggaggtcgttaagaagatgaagaactactggcgccagctcctgaatgccaagctgatcacgcagcggaagttcgataacctcacaaaggctgagaggggcgggctctctgagctggacaaggcgggcttcatcaagaggcagctggtcgagacacggcagatcactaagcacgttgcgcagattctcgactcacggatgaacactaagtacgatgagaatgacaagctgatccgcgaggtgaaggtcatcaccctgaagtcaaagctcgtctccgacttcaggaaggatttccagttctacaaggttcgggagatcaacaattaccaccatgcccatgacgcgtacctgaacgcggtggtcggcacagctctgatcaagaagtacccaaagctcgagagcgagttcgtgtacggggactacaaggtttacgatgtgaggaagatgatcgccaagtcggagcaggagattggcaaggctaccgccaagtacttcttctactctaacattatgaatttcttcaagacagagatcactctggccaatggcgagatccggaagcgccccctcatcgagacgaacggcgagacgggggagatcgtgtgggacaagggcagggatttcgcgaccgtcaggaaggttctctccatgccacaagtgaatatcgtcaagaagacagaggtccagactggcgggttctctaaggagtcaattcggcctaagcggaacagcgacaagctcatcgcccgcaagaaggactgggatccgaagaagtacggcgggttcgtcagccccactgtggcctactcggtcctggttgtggcgaaggttgagaagggcaagtccaagaagctcaagagcgtgaaggagctgctggggatcacgattatggagcgctccagcttcgagaagaacccgatcgatttcctggaggcgaagggctacaaggaggtgaagaaggacctgatcattaagctccccaagtactcactcttcgagctggagaacggcaggaagcggatgctggcttccgctcgcttcctgcagaaggggaacgagctggctctgccgtccaagtatgtgaacttcctctacctggcctcccactacgagaagctcaagggcagccccgaggacaacgagcagaagcagctgttcgtcgagcagcacaagcattacctcgacgagatcattgagcagatttccgagttctccaagcgcgtgatcctggccgacgcgaatctggataaggtcctctccgcgtacaacaagcaccgcgacaagccaatcagggagcaggctgagaatatcattcatctcttcaccctgacgaacctcggcgcccctcgtgctttcaagtacttcgacacaactatcgatcgcaaggtatacagaagcactaaggaggtcctggacgcgaccctcatccaccagtcgattaccggcctctacgagacgcgcatcgacctgtctcagctcgggggcgacaagcggccagcggcgacgaagaaggcggggcaggcgaagaagaagaagtag

SEQ ID NO: 190 - protein, 1400 aa, Artificial Sequence
  pCas9-NG
MAPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGDKRPAATKKAGQAKKKK

SEQ ID NO: 191 - protein, 552 aa, Oryza sativa
PEFPSGREIIVVANDITFRAGSFGPREDAFFEAVTNLACEKKLPLIYLAANSGARIGIADEVKSCFRVGWSDDGSPERGFQYIYLSEEDYARIGTSVIAHKMQLDSGEIRWVIDSVVGKEDGLGVENIHGSAAIASAYSRAYKETFTLTFVTGRTVGIGAYLARLGIRCIQRLDQPIILTGYSALNKLLGREVYSSHMQLGGPKIMATNGVVHLTVSDDLEGVSNILRWLSYVPAYIGGPLPVTTPLDPPDRPVAYIPENSCDPRAAIRGVDDSQGKWLGGMFDKDSFVETFEGWAKTVVTGRAKLGGIPVGVIAVETQTMMQTIPADPGQLDSREQSVPRAGQVWFPDSATKTAQALLDFNREGLPLFILANWRGFSGGQRDLFEGILQAGSTIVENLRTYNQPAFVYIPMAAELRGGAWVVVDSKINPDRIECYAERTAKGNVLEPQGLIEIKFRSEELQDCMSRLDPTLIDLKAKLEVANKNGSADTKSLQENIEARTKQLMPLYTQIAIRFAELHDTSLRMAAKGVIKKVVDWEESRSFFYKRLRRRI

SEQ ID NO: 192 - protein, 770 aa, Oryza sativa
GPLHGVALNNPYQPLSVIDLKRCSARNNRTTYCYDFPLAFETAVRKSWSSSTSGASKGVENAQCYVKATELVFADKHGSWGTPLVQMDRPAGLNDIGMVAWTLKMSTPEFPSGREIIVVANDITFRAGSFGPREDAFFEAVTNLACEKKLPLIYLAANSGARIGIADEVKSCFRVGWSDDGSPERGFQYIYLSEEDYARIGTSVIAHKMQLDSGEIRWVIDSVVGKEDGLGVENIHGSAAIASAYSRAYKETFTLTFVTGRTVGIGAYLARLGIRCIQRLDQPIILTGYSALNKLLGREVYSSHMQLGGPKIMATNGVVHLTVSDDLEGVSNILRWLSYVPAYIGGPLPVTTPLDPPDRPVAYIPENSCDPRAAIRGVDDSQGKWLGGMFDKDSFVETFEGWAKTVVTGRAKLGGIPVGVIAVETQTMMQTIPADPGQLDSREQSVPRAGQVWFPDSATKTAQALLDFNREGLPLFILANWRGFSGGQRDLFEGILQAGSTIVENLRTYNQPAFVYIPMAAELRGGAWVVVDSKINPDRIECYAERTAKGNVLEPQGLIEIKFRSEELQDCMSRLDPTLIDLKAKLEVANKNGSADTKSLQENIEARTKQLMPLYTQIAIRFAELHDTSLRMAAKGVIKKVVDWEESRSFFYKRLRRRISEDVLAKEIRAVAGEQFSHQPAIELIKKWYSASHAAEWDDDDAFVAWMDNPENYKDYIQYLKAQRVSQSLSSLSDSSSDLQALPQGLSMLLDKMDPSRRAQLVEEIRKVLG

SEQ ID NO: 193 - protein, 737 aa, Saccharomyces cerevisiae
PIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIK

The invention claimed is:

1. A method of identifying an agronomically important phenotype in a cellular system, comprising the following steps:

(a) selecting at least one nucleic acid sequence of interest in the genetic material of the cellular system;

(b) providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest, and further wherein the at least one STEME complex comprises a STEME having an amino acid sequence with at least 96% identity to either SEQ ID NO: 176 or SEQ ID NO: 184;

(c) introducing the at least one saturated targeted endogenous mutagenesis editor (STEME) complex, or the sequence encoding the same, into the cellular system;

(d) obtaining a cellular system comprising at least one modification in the at least one nucleic acid sequence of interest;

(e) cultivating the cellular system under conditions to obtain a M0 population of the cellular system;

(f) screening the M0 population of the cellular system for the agronomically important phenotype associated with the at least one modification in the at least one nucleic acid sequence of interest; and (g) identifying and thereby selecting an agronomically important phenotype in the cellular system, wherein the array of guide RNAs of the at least one STEME complex comprises at least one guide RNA molecules, or a sequence encoding the same, targeting the at least one nucleic acid sequence of interest.

2. A method of identifying an agronomically important phenotype in a cellular system, comprising the following steps:

(a) selecting at least one nucleic acid sequence of interest in the genetic material of the cellular system;

(b) providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest, wherein the at least one STEME complex comprises a STEME having an amino acid sequence with at least 96% identity to either SEQ ID NO: 176 or SEQ ID NO: 184;

(c) introducing the at least one saturated targeted endogenous mutagenesis editor (STEME) complex, or the sequence encoding the same, into the genetic material of the cellular system;

(d) cultivating the cellular system under conditions to obtain a M0 population of the cellular system;

(e) crossing the M0 population of the cellular system with a wildtype population of the cellular system comprising the at least one nucleic acid sequence of interest to obtain a progeny population of the cellular system;

(f) obtaining a progeny population of the cellular system having at least one modification in the at least one nucleic acid sequence of interest;

(g) screening the progeny population of the cellular system for the agronomically important phenotype associated with at the least one modification in the at least one nucleic acid of interest; and (h) identifying and thereby selecting an agronomically important phenotype in the cellular system, wherein the array of guide RNAs of the at least one STEME complex comprises at least one guide RNA molecules, or a sequence encoding the same, targeting the at least one nucleic acid sequence of interest.

3. A method of generating a modified cellular system having an agronomically important phenotype, the method comprises the following steps:

(a) selecting at least one nucleic acid sequence of interest in the genetic material of the cellular system;

(b) providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest, wherein the at least one STEME complex comprises a STEME having an amino acid sequence with at least 96% identity to either SEQ ID NO: 176 or SEQ ID NO: 184;

(c) introducing the at least one saturated targeted endogenous mutagenesis editor (STEME) complex, or a sequence encoding the same, into the cellular system;

(d) obtaining a cellular system comprising at least one modification in the at least one nucleic acid sequence of interest;

(e) cultivating the cellular system under conditions to obtain a M0 population of the cellular system;

(f) screening the M0 population of the cellular system for the agronomically important phenotype associated with the at least one modification in the at least one nucleic acid sequence of interest; and (g) identifying and thereby selecting a cellular system from the M0 population having the agronomically important phenotype; and (h) obtaining a modified cellular system having the agronomically important phenotype, wherein the array of guide RNAs of the at least one STEME complex comprises at least one guide RNA molecules, or a sequence encoding the same, targeting the at least one nucleic acid sequence of interest.

4. A method of generating a progeny of a modified cellular system having an agronomically important phenotype, the method comprises the following steps:

(a) selecting at least one nucleic acid sequence of interest in the genetic material of the cellular system;

(b) providing at least one saturated targeted endogenous mutagenesis editor (STEME) complex, or a sequence encoding the same, wherein the at least one STEME complex comprises an array of guide RNAs, or a sequence encoding the same, targeting the at least one nucleic acid sequence of interest, wherein the at least one STEME complex comprises a STEME having an amino acid sequence with at least 96% identity to either SEQ ID NO: 176 or SEQ ID NO: 184;

(c) introducing the at least one saturated targeted endogenous mutagenesis editor (STEME) complex, or a sequence encoding the same, into the genetic material of the cellular system;

(d) cultivating the cellular system under conditions to obtain a M0 population of the cellular system;

(e) crossing the M0 population of the cellular system with a wildtype population of the cellular system comprising the at least one nucleic acid sequence of interest to obtain a progeny population of the cellular system;

(f) obtaining a progeny population of the cellular system having at least one modification in the at least one nucleic acid sequence of interest;

(g) screening the progeny population of the cellular system for the agronomically important phenotype associated with at the least one modification in the at least one nucleic acid of interest; and (h) identifying and thereby selecting a cellular system from the progeny population having the agronomically important phenotype, (i) obtaining a progeny of a modified cellular system having the agronomically important phenotype, wherein the array of guide RNAs of the at least one STEME complex comprises at least one guide RNA molecules, or a sequence encoding the same, targeting the at least one nucleic acid sequence of interest.

5. The method according to claim 1, wherein the array of guide RNAs comprises at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, or more individual guide RNA molecules targeting the at least one nucleic acid sequence of interest.

6. The method according to claim 5, wherein the guide RNA molecules target overlapping and/or distinct fragments of the nucleic acid sequence of interest.

7. The method according to claim 1, wherein the at least one STEME complex or a component thereof is introduced as part of at least one plasmid, at least one vector, or at least one linear DNA molecule, as RNA molecule and/or as a preassembled complex of RNA and/or protein.

8. The method according to claim 1, wherein the at least one STEME complex is introduced into the cellular system by biological or physical means.

9. The method according to claim 1, wherein the at least one nucleic acid sequence of interest is/are (an) endogenous gene(s) or genetic element(s) associated with an agronomically important phenotype.

10. The method according to claim 9, wherein the endogenous gene(s) is/are selected from the group consisting of a gene encoding resistance or tolerance to abiotic stress, a gene encoding resistance or tolerance to biotic stress, or a gene encoding a yield related trait.

11. The method according to claim 9, wherein the genetic element(s) is/are at least part of a regulatory sequence, wherein the regulatory sequence comprises at least one of a core promoter sequence, a proximal promoter sequence, a cis regulatory sequence, a trans regulatory sequence, a locus control sequence, an insulator sequence, a silencer sequence, an enhancer sequence, a terminator sequence, and/or any combination thereof.

12. The method according to claim 1, wherein the STEME complex induces at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, or even more nucleotide exchange(s) in the nucleic acid sequence of interest.

13. The method according to claim 1, wherein the cellular system is selected from a eukaryotic organism, wherein the eukaryotic organism is a plant, part of a plant or a plant cell.

14. The method according to claim 13, wherein the part of the plant is selected from the group consisting of leaves, stems, roots, emerged radicles, flowers, flower parts, petals, fruits, pollen, pollen tubes, anther filaments, ovules, embryo sacs, egg cells, ovaries, zygotes, embryos, zygotic embryos, somatic embryos, apical meristems, vascular bundles, pericycles, seeds, roots, and cuttings.

15. The method according to claim 13, wherein the plant, part of a plant or plant cell is, or originates from, a plant species selected from the group consisting of: *Hordeum vulgare, Hordeum bulbusom, Sorghum bicolor, Saccharum officinarium, Zea mays, Setaria italica, Oryza minuta, Oriza sativa, Oryza australiensis, Oryza alta, Triticum aestivum, Secale cereale, Malus domestica, Brachypodium distachyon, Hordeum marinum, Aegilops tauschii, Daucus glochidiatus, Beta vulgaris, Daucus pusillus, Daucus muricatus, Daucus carota, Eucalyptus grandis, Nicotiana sylvestris, Nicotiana tomentosiformis, Nicotiana tabacum, Solanum lycopersicum, Solanum tuberosum, Coffea canephora, Vitis vinifera, Erythrante guttata, Genlisea aurea, Cucumis sativus, Morus notabilis, Arabidopsis arenosa, Arabidopsis lyrata, Arabidopsis thaliana, Crucihimalaya himalaica, Crucihimalaya wallichii, Cardamine flexuosa, Lepidium virginicum, Capsella bursa pastoris, Olmarabidopsis pumila, Arabis hirsute, Brassica napus, Brassica oeleracia, Brassica rapa, Raphanus sativus, Brassica juncea, Brassica nigra, Eruca vesicaria* subsp. *sativa, Citrus sinensis, Jatropha curcas, Populus trichocarpa, Medicago truncatula, Cicer yama-shitae, Cicer bijugum, Cicer arietinum, Cicer reticulatum, Cicer judaicum, Cajanus cajanifolius, Cajanus scarabaeoides, Phaseolus vulgaris, Glycine max, Astragalus sinicus, Lotus japonicas, Torenia fournieri, Spinacea oleracea, Phaseolus vulgaris, Vicia faba, Allium cepa, Allium fistulosum, Allium sativum,* and *Allium tuberosum.*

16. The method according to claim 8, wherein the at least one STEME complex is introduced into the cellular system by transfection, transformation, a viral vector, biolistic bombardment, transfection using chemical reagents, or any combination thereof.

17. The method according to claim 8, wherein the at least one STEME complex is introduced into the cellular system by transformation by *Agrobacterium* spp.

18. The method according to claim 8, wherein the at least one STEME complex is introduced into the cellular system by transformation by *Agrobacterium tumefaciens.*

19. The method according to claim 8, wherein the at least one STEME complex is introduced into the cellular system by polyethylene glycol transfection.

20. The method according to claim 10, wherein the abiotic stress includes drought stress, osmotic stress, heat stress, cold stress, oxidative stress, heavy metal stress, nitrogen deficiency, phosphate deficiency, salt stress or waterlogging.

21. The method according to claim 10, wherein the herbicide resistance includes resistance to glyphosate, glufosinate/phosphinotricin, hygromycin, protoporphyrinogen oxidase (PPO) inhibitors, ALS inhibitors, or Dicamba.

22. The method according to claim 10, wherein the gene encoding resistance or tolerance to biotic stress includes a viral resistance gene, a fungal resistance gene, a bacterial resistance gene, or an insect resistance gene.

23. The method according to claim 10, wherein the gene encoding a yield related trait includes lodging resistance, flowering time, shattering resistance, seed color, endosperm composition, or nutritional content.

* * * * *